United States Patent 11,446,398 (REGULATED BIOCIRCUIT SYSTEMS) - sequence listing, part 53

SEQ ID NO: 146014 - DNA, 6230 bp, Homo sapiens
  Payload ID: 8952
  Gene Symbol: KIAA1551
  Gene Name: KIAA1551
  Uniprot ID: Q9HCM1
  ENST ID: ENST00000312561
  CDS Start-End: 415-5658
gacttaaactctggggcccgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaacgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttctaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagactcatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaacctgtctttccctgtggaaaaagcaaccttcagatactgcaaaagaaaaggagtgtgataaactcagaacaaacacaacagcagttggaatttcaaagcctgctaacatccacgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacagtgtatcccgttattaaagaaggcagtgtttgtagtttacaaaatcaattggcagaaaatgcaaaggcaactgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacattacagattgacaatatttgttctctggttgaaggtgatacctcttacaattcccaaatagcaaagatattcagctctcttcccttgaaaatggttgagccacagaaaccttctctacccaatcagcaagggattggcagcagagaaccagaaaaacaattagataataccactgaaaataaagactttggttttcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatacgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccccagtgtcagtgtaattccatcaagaactcatcttcagaggaagagaaacaaaaagagcagtgttctcctttggataccaacagttgtaaacaaggagagagaacttctgatagagatgtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacccgacagaagaaacatgtaacacagaactcacgtccactaaaaacaaaaacagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacatatgagaccaagtaaacttgccgtgcaggttgaaagttgtgggaaatcaaatgagaaacacagcagcggcgtgcagacctctaaagaatcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagacaggaaaataaacataagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaagtttcaggaataaaaagtacaaaagaagactggttaaaatttgttgctacaaagaaaaggacacagaaagacagccaagagagagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcccactttcattgtatttcattgaaagtgcttaattaaaatggcttgagaactttgggtagccatgtgtaagaaatggatggtattcaccggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtgaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaa

SEQ ID NO: 146015 - DNA, 2326 bp, Homo sapiens
  Payload ID: 8952
  Gene Symbol: KIAA1551
  Gene Name: KIAA1551
  ENST ID: ENST00000381054
  CDS Start-End: 303-2326
attcctaataccttaagtgtacttgtaagtgaagagcaaagttggaggctgttgagctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccaatttcacagccactgctgaatatccaaaattatcctcaacaaatttctgtttctgatatgcataatgggacagttgtggcctcacacacttcagtagaaagaataacatatgcaaatgttaatggacccaaacaactaactcacaatttgcagatgtcttcaggagttacccaaaacgtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtatatctaagggactgacttacccagattacagaccacctccaaagctataccgttactcaccacaaagctttttaccagattctaccattcaaaaacaaaactttataccacatacatcattgcaagttaaaaatagtcagcttctaaattctgtattaactttaccatcaaggcagacctcagctgtaccatcacagcagtatgccacgcaaactgacaaaagacctcctcctcctccttacaactgtagatatggaagccagcctttgcaaagtactcagcatattactaaacacttgtctatggaagttcctcagagtcgagaaatgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatacttcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagactcatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccatgtccactgaggaatataaatcaaaaattcaaaatgaaaatatgctacttctcgctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacaactccttttgcagtggacaagaatcctcaacaaaaggaatgcctgctaaaagtgacagtagctgttccatggaagtgctagcaac

SEQ ID NO: 146016 - DNA, 362 bp, Homo sapiens
  Payload ID: 8952
  Gene Symbol: KIAA1551
  Gene Name: KIAA1551
  ENST ID: ENST00000540924
  CDS Start-End: 258-362
ggaccccacttgacttaaactctggggcccgggaggccgccggttttctccccgcttgccggggtggtcctcttccctttgtcggaccaaagaagtaaacactgtgtggagagggactgacgtgtttggagggaaatgggaatgtacacgataattaaagagtaaagttgtgctcaacgattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaaca

SEQ ID NO: 146017 - DNA, 2933 bp, Homo sapiens
  Payload ID: 8953
  Gene Symbol: KIAA1586
  Gene Name: KIAA1586
  Uniprot ID: Q9HCI6
  ENST ID: ENST00000370733
  CDS Start-End: 208-2571
gagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaaataatagaatctgtccctccagctggccctgaggcatctgagtcaacaacggatgaaaatgaagacgacattcagtttgtcagtgaaggaccatcgagacctgttcttgaatacatcgatctggtctgtggtgatgatgaaaaccctagcgcctattatagtgatattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtcttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaa

SEQ ID NO: 146018 - DNA, 2883 bp, Homo sapiens
  Payload ID: 8953
  Gene Symbol: KIAA1586
  Gene Name: KIAA1586
  ENST ID: ENST00000545356
  CDS Start-End: 225-2507
aggaagcccgggaatgagagaaagaggctccggggagatagcggaccagtgagggctgcccctcttttgaagcggttttcgtctctttccgccagtggcctcccagctcacgcaggggcgggtcccggtagcgcgaggcggtgcagggcgggaaggggagtggtggcggctgcggcagtagggacagcaggagcagtggtgctgtcagcgcggccgtcggagacatgggagacccggggtcggaaataatagaatctgtccctccagctggccctgaggcatctgagtcaacaacggatgaaaatgaagacgacattcagtttgtcagtattctgtttcctaaaatgccaaaacgacagggtgattttttgcattttttaaatgtgaagaaggtgaaaacagacacagaaaataatgaagtgagcaaaaatcactgcagattgtctaaggcaaaggaaccacatttcgagtatattgaacaaccaatcattgaagaaaagccatcactttcatcaaagaaagaaatagataatcttgtgcttccagattgttggaatgaaaaacaagcatttatgtttacagaacaatacaaatggcttgaaataaaagaaggtaaattaggatgtaaggattgttcagcagttcggcatttgggatcgaaagcagaaaagcatgtccatgtgtccaaggaatggattgcatatttagtaacccctaatggcagtaataaaactactaggcaagcttctctacgaaaaaaaattagggaacatgatgtttctaaagcccatggtaaaattcaggatttgttaaaggaatcaactaatgattcaatttgtaatttagtgcataaacaaaataataaaaatattgatgctactgtaaaagttttcaatactgtttacagtttagtaaaacataacagacctttatctgatattgagggggcaagagaattacaggaaaaaaatggagaggtaaattgtttaaatacacgttacagtgcaacaagaatagcagaacatattgcaaaagaaatgaagatgaagatatttaagaatattatagaagagaatgccaaaatctgtatcataattgatgaggcatctacagtttcaaagaaaaccaccctagtgatttatctccagtgcacaattcagtcagctcctgcacctgttatgttatttgtggctttaaaagaattggtgtcaactatagcagagtgtattgtcaatacattattgactactttaaatgattgtggttttacaaatgaatatttgaaagcaaatttaattgcattttgttctgatggtgctaatacaatcctgggaagaaagtctggagtagctacaaaattgttagaaaattttcctgaaatcatcatttggaactgtttaaatcatcgattacaattgtcacttgatgattctatatccgaaataaaacaaattaatcatttaaaaatatttattgataaaatttattctatttatcatcaacctaataaaaatcaaaccaagcttctaggaactgtagctaaagaacttgaaactgaaattattaaaattggtcgagtaatgggaccaagatgggcggcatgtagtttacaagctgctactgctgtatggcatgcatatcctatattatatatgcatttttctcattcttactctggtttggcgaagagattagctaacattaatttcttacaagaccttgctttaatgattgacattcttgaagaattttcagtactttcaactgcattacagtcaagatcaactaatattaagaaagcacaaaaattgatcaaacgtaccataagagctttggaaaatttaaaaattggtactggaaagtatgaatctcaaattgaagatttgatcaagtcagataagtttaaagatattccatttaataaaaacaataaatttaatgctcttcctaggagtatattactagacaatataattcagcacatgaacctacgccttttatctgacagaaaccatgaagatatttttaattactttgatttgctggaaccttccacatggccttatgaagaaataacttcaccatggatagctggtgaaaaaacattatttcatttgtgtaaaattttaaaatatgaagttgatttgaatgattttcgggaatttgtaaataataatataaaatcaaacaatgtttcaattcctacaactatatacaaagctaaaaagatagttagcaccattgcaatcaatagtgctgaagctgaaaggggtttcaatttaatgaacataatttgtacaagggtgagaaatagtttaacaatagatcatgtatcagatttaatgacaataaatttactggggaaagaattagcagattgggatgcaacaccgtttgtaaaatcttggtcaaattgcaaccacaggttggctacagatacaagagttcggcaaaagtcaacaaaagtcttccatgagaatcaattggctatatggaacttaaaatagaatattgtatacgttttttgtcatctgtaaattatgtactacacatcctttatatacataaaggtcttttttttttttggaaagccagttaaacttttatcagcatgttgctgtttaaaaggcgttctttaagaagataatcttgaagattggttttagaagctatagttttttagagattggcccatgtttgctagagtgggtcataatacatattccatgaagttctgtacagaacaaacaccgtttataattttgtactgttttactttaagtaaggatgcaaaaaatagcaggactcagctaagttctaagccctggaggttatattaaataaaagagaaatggaataaaaactgtaagccttttggctctt

SEQ ID NO: 146019 - DNA, 3309 bp, Homo sapiens
  Payload ID: 8954
  Gene Symbol: KIAA1614
  Gene Name: KIAA1614
  Uniprot ID: Q5VZ46
  ENST ID: ENST00000367587
  CDS Start-End: 360-2795
agatcctcttgaggtctctgcctccagtgcctgagcagatgtccaaggccgggccagctccccagcccccatccagagccacgcagggccatttcccagccccaggccccaggccccaggcccccaggctgggttccctgtgcgtgggtgctagaggaggaaggctgcacatgcagggctttttctggcacagccagtgcttgacactgctaaagccctcctaatctgcgttattttcctctaatccctcccccaccaccctggcctgtgtgccacgctgcaggaccgttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaaggggaaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatct

SEQ ID NO: 146020 - DNA, 9654 bp, Homo sapiens
  Payload ID: 8954
  Gene Symbol: KIAA1614
  Gene Name: KIAA1614
  Uniprot ID: Q5VZ46
  ENST ID: ENST00000367588
  CDS Start-End: 56-3628
cagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccagcctgatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccagagcgaccagtgggggatgtggactgggcctcgggcacctccttgcaggactccggccagaacaggaccgttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaaggggaaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatctcaaaggaaaaaaaaaaagaaataaataaattagaattttgaaggccatctttgcagaggagagccagagggaaactgtctgtgcctgctggttctcagcagtccctttgatgtggctgcgttgaaacggttcctttcctccggctgtggagtatgtctgggcacgtggagcatgcctgtctgtctctgcatcccgtccctccctcaggcctgtgcccgatgattatgttcagatgaatcctggctgcaggcctctgactggggtgtgctctgggtctcaattcaacccaggcaatggcagggagaagtcctggacatcattctgcactctgaccagttctcagttccaccccatccatgagtctttcagggcaacgtgacttgcaaaagcccacgcccaaggtctgtggtccagaatgcatctcaagggcccataaaagacattccccagaggatcagggaaggaagacacgtatgtgagggtggggaaggaggggaggggaaggaaggagagagaaagggagagacagatacagaaagacgaacacagaagcctgctgcggccgggctctgccgatggggggttgagtcctgtgctttgatctcctagctcaatgctgtttagcctggaaaaaagtctgcctgctaccacatttgcagaccacagcatgagttctcatgtctgttccatcattgtttcagcaaatatatactaagcacctactatgtgttatagatacgggggatacagcagtaaatggaacagaccaaatccctatcctcatgaatatactacccagtgagcagttagattgtatctataaaatgtgtactcttgttatgtataatgtgctacgtatgtcagatggtgaaaagaaagttctgagaaacagacagataaagcaggtgtggcaggtgctggtatagacaggagtgtggggaggcttttctgagaagatgacacttgagcagggccgtggatggggcgaggaaggggccccatgggtgtctggggaagagcattccggcagactgaacagcaagtgcggagccctggtggaggggcgagcctggcctgtgagaactgtgagggtcaggctggacactgcagagcaggcaacgggttgggaggagcagagtttggaaagatggggttgtgccactgtaaggggctttggctttcatgccgaatgagatgggagccactagagggctcggagcgagcactgagactctctaatgtctatgagaatagaccccagtgggacacgggtggagccagggagccctgtgttgaagctatttcagcagtccaggacagagacagtggtgcctggactgggaacggctgtggagatggggagaggggagaggggacaggggttggattctggttgatttgactatttgctgatgagctggacatgtaagaggaagagaggacaggtctctgcctactctggacctcaggaggataaaaagtccttcctcacaggccttcccgtagcctcctctcccgttaggggagcaggacaggccccccggacaggtggtgtgaaggcagaggcagacaacgcagcatgtttgtgctccggcacctctgctggctatgtgatctagagcaggcgacatccccactgagcctcactcagttccctaatctgtgaaatgaggatgacaaaacctacctagaagagtcataaggagcatttggtaaggcacacaggaaagggcctagcatttttcttccctccccttcagaaagagaaagtctggggaagagaaccccagacagggaccagcgtgatccgcattcacctgtcgatgtgagtgcacacacaacaggtcattgtactctgccgcccaccctcccccagagtccctttttgctcccttgtaggcagtgggagcccctccctgtcacccgtcagggagctctgatgggcaggggtctctagtgacccagggcccccggcaccctcgcctgagttggtgccagctccccgttgtgcccaggcactccctggtcctgctgccatcatgggcgctggatggcacacaggggtccccacgcacatgaagcctggcgagtgctggggcctccgtgtcccaggccatcctccaacagcagagggtcgcttcttccaggctccaaggggctgtgaggagggctggcttgcgccccgcactgaaccggcaggatgctggtattaacttgctggctttcacatccgactctatatgagcctgtgagaacagcaggctttgccttctgcttctaattggatacaacatagagatcacacatcctcaacaaaggccatttccagcagacaataaatgcctatgacagcaggctgtcatatttgtgtcacgaatttcagttgcgaaacctacccgagtctccccaaaatggcaggcgtgacgtcagtgtctggcctagctctggcagcattctttcagggtttatcattagtccccacctgcaactcccacagcacatcagacacttctctgggtttgccccaggggccccttcttacctgccccctccccgtgccaccaacccgtagacagggagggcaagcagtgaaaggtccatctagaggaggtaaaagacagggctgagggaaaacgccttgtacagtcaggatggcagatgtactctgtcagggaagacagccccacagaaaaggctcggcttggccaagaagcaacaaaagggattctacacctcagaccagggagggggaatgtgtacaaagattggatttactaaattcagagccacagactttcaggtacttcggtgaagatcagtgctctttcaaacccacacttcagaggcaggctttaaaacgcctgacttctgtcagggccacaggctgggctgcccaaagctcctacggggctgggggatccgagagaggacttcccactagtccaagatgtggtgactagtttcaagccagagattgaggagcagacctgatgccctttcgggcccctgctaagaacctgattcgaggaaaaggaagtgaagacagtaacgcgtgggcagtggcctcatgtctgaaatgcagagtgagccgagctgggctgcgaacagcgagggtgccaaaggctgcgctgagcagcctgaattccgccagtgctgatgcccacaccaggggtgtgccccgcagtccctccagcaaactcagcttgtgtctcagcccctgtgtccacccagcatgaagcatgggcatcagggggtccagcctgccctgggagagccagcacctcacttactctcccaggtgggagcagctggaggggaatttgaaaggtttccagccgcggttgaggccggcgggcgggggttgggggcagggggcctcctcagctggacacttcccagcccagccagcccaagccccacagggcctgccccactgacggggggctccctgagagccggagcctggcaaagaagcagagaagctagttcccgcaggctggctcttggcaccttctagacccaggcagggcctctttggggtggggaggagggggcatgtgcagaagaggagagggagccaccgcagctttgaaatatgtggctagaatttttatttttcctggggttttttgctcagatgcttccccatcccaattgaggagccatatctgagtaagactgaggccagtgtcagtctttggcaatagagtgcagcaaaccaggcttggatgtggctcagccacttttgctcttccgatgataccttcccaccaccccggcctttacgctgggcctgggtgacctgaggcagcaactggatcatagtgccaggcactgagtaggtatggttcctaatttttaaaaactattttcctcccaattctacaagaaaagctcatctcagaaaaagattagctcactcactgtcaggtataaataaatgacaacagtttaacgcgttatttgcactaggagcatttccactttaaaagcagagacagtggaatggagttagaccatggaggaggcgcactgtatctatgtctaaagccagttgtggttgtgagatggaataatgaggggtgtgtgtatgtgtgcatgcgcacagagaagtgcctggtatgagcacctcctccctgtgccacacaaacagcacctcatcaacatggtcagcattccagagatgcacttcttcgatttgggtgtcattgtgaaattctcctgttttcctctgcagggatctacgtgcaggagatggctgacatgagcatggccaagctgtactcagggctgctgggggtgggcgatgagatcctcgaggtgaacggggccaaggtggcagggctgggcttggctcacattaaggagctcctggcccactcagagagcttgtcaatccgtgtcctgaggcagagacctgtcccacggtgacccagaagtgccgctgccctcactgtcacggcctcggaagccctgaagcactcagggtggttggcaggaacgtgctgcacagagctgctctgtggcggaaacagatcctggcagcatctaaccccttgggctgtggcagggcttctgtggtgggctgcctttgggagacgcaaggagcctgtttgcatattttgtttaaggccatttatccagaactagaaaaagaaaaaaatgggtctccttccatgtctgagggggtgtcaacatctacttgtacctttgttggcagggggagaagggagattcagtggatcctttggttgatgcctgagagccggcctcacctcctggtcccatgcctggtcaaaggctacagcctccaacactgtggaaccaaagaaagcacatgtccatattggccttgacccttccctatttcagccacgttcctccctactccattcactgcccttgccctttatccagaaatgggcaaagtgtcccggaataccagccttacagccattgaccatatatgccaaaccaaaatcagaacgtgtggtctggcaggagttttatgccccttcggggtgtgggaattctgggagatgttatctggtagccagaatattaaaaatttctaggaaaatttttttatacataaagttgaaaacaacaacaacaacaacaaagaccaatttcaggacgtgctactgtggtagccaggatccagctagtgggaccggccagaccagccccatgccaccccggccgctgcctctgcccaggtggaggcaagagttgctgcaacctgacctgtggcagcctccatcttagttctgtccagcttggagacagggctgcggcaggtgcctggccatcacagctgcatgctttctgcccagacctcctggcggtgctgtcggtgggcaggtgggtgggtgggcagcagggaagctgcagagcgcggctgggccatctgcctgggcctcagtgctgcctggagggctgggactctttgggagtggatggccatgtgtcagtcttaacttactaaaaagcaaagctaaagcttctctca

SEQ ID NO: 146021 - DNA, 6751 bp, Homo sapiens
  Payload ID: 8955
  Gene Symbol: KIAA1644
  Gene Name: KIAA1644
  Uniprot ID: Q3SXP7
  ENST ID: ENST00000381176
  CDS Start-End: 134-733
aaggttggtggcaaccaggagccggggaagaggccagcagctgcagggagaccgcagccagcggagggggcttctgatccctcagtcacagggctcggcaggcagctctggacggatcaatgcaagccagacgatgaccagttgtggccagcagtccttgaacgtgctcgccgtcctcttctcattgctgttttctgcagtcttgtctgcacatttccgggtctgtgaaccatacacagaccacaaaggccgctaccactttggcttccactgcccccggctctcggacaacaagaccttcatcctctgttgtcaccataacaacacggtcttcaaatactgctgcaacgagacggagttccaggcggtgatgcaggcgaacctcacggccagctccgagggttacatgcacaacaattacaccgccttgttgggagtgtggatctatggatttttcgtgttgatgctgctggttctggaccttttgtattactcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgaccttccagagttcgtctgcctgaaaacgcttttgctgtgcctcaggatgggggagatgagatctgaagcacccggtgcagcctccgagaagaacaacttctacagagatgccagggacagccgaggtagcggcggtggcacaggaggaaatgctgcctgtgcccaaagcccccttccgcggacttctaagattaggagcaaactcaggggtaggggctgggggtgcaggggaggggattctgagccacctgtccgcaagcaatagtcctattttgggctggtggcttctgagaggtgactcattgtggactcaggatgaccaagacaaagcaactctggctgattccagccaggaggattgaggcctgtgagttatacctgtggttgaaaaccgaagcttcccttgcccctgctccctccagtagtggccccttggggctatttgtgtcagaatattgaatgtgcgtgtgtgtgtgcgtgtgtgtgatttggggtgttctttttgtttgcttggttggttggtttttattggggcttcccccctcaagttctctgatgggcatgagtcaccctccggctgggggttctcatccgtgtcaatgtccgagccgcaagcttattgctaagcacagggtacggcccctctgtgtctcggggagcactggggatttgaaaatgccagtcagggttgtttcttacagaattcgttcctgtaacaatagtaatactaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagctcgggaggccctgcttgatcaatgtgtgtgtcctctgacgcagtttcctcatttcatcagacctagtgttctcacactgaccacccatccattcaccagacacgacagtgagcaaggcaggtccctgctcactgtgctagctttctagctggggcaggaagacagtgaagaaggaaggtggcgaaggcagtgagtgctctgccgggaactcagtgccaggaactcagttcgagggacacgtgagtgagacccttgtggacctggggtggtctgggaaggccgccttgagcagatgattgaagcccagatttgaatgacacacaggagccagtaatgggcgttaaagataggaaaagagcattccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctgtgagtcaagctgtgcaaacacaatgtcctgcctttggaaaagcagaacaaacttgctagggtataaagcatcctccattctgcctggctgtccatcctctcaacagccccatgaagaaggggctctccccattttatggacaagaagacagactcagctgggtcaagtggcttgcccaggatcacacaggtcagctgtggaagacccaggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaagggggtgcacagcctgtccactagcccagctgcggaagccacagctgtgtcccacgtgcagtgcctcagaaggcagaggaagccttgaggtgggggcccaagacccagattctgacatcagctctgccactgagaacagcgtgacctcaggcaaggtctgttacctcagtttccccatcggtaagaggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccgagtgcctgccacttgcctggccctgtacccagggcccatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtcaactgttccc

SEQ ID NO: 146022 - DNA, 10490 bp, Homo sapiens
  Payload ID: 8956
  Gene Symbol: KIAA1671
  Gene Name: KIAA1671
  Uniprot ID: Q9BY89
  ENST ID: ENST00000358431
  CDS Start-End: 27-5447
acccccatgaatccacaaccataaccatggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgttttcaagttcagcttccagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaatcacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttcttcatggtcctttgcctaatcaaacagaggcttttggcctttgaaaatccatgacaaggcctcagaaatcagtgttgtggaggattactccatgccaccggagaaactctggtgaaagagaaacctcgtggtctttaggatgttgggattttgagtgaacctgacctgatagcctcaggattcagggaaaggacaatcagatggcggtgttttccagggggacgcgccaaatcatgtggtttcagacaattgtgtttgcctttgtgcctccctggaagggaggccaactaagggtatcaccaagaagccaaaagagaaataggcatgagcctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctggaactagtcgtaattgcaaactgtaaaaatccctcctccccagtgtagatatttaaaccagagtaagtgatggggagacattctgtggtctctgaatgtgccttccccctcaccgtgtgttaaaacacaaaagccgaagttccatggcatcatgattccgaggggctggagggataggacccactccacatctaaaggggatctgctttgggctcggtcccattagcgagtgggggactcttgctgtgtgctaagaggctgctaggactcacccagttggaattctgggtgggctcaggaagtttagagccacgtaaaaagctggtaggcatgagtgtgccaggtctttgccagcctgcgtctccttttgcaccccccaatccagagtttgctttcttttgactaaattggctcctgcagggggaagggcagaaagctaggccctctgctctggaaagtcggcctgaggtttccggcaagttaacccttaaaatggacacccctcagcccgccctcccctttggccttcccagaatctccttcagtggttgctctcacacctgtgccataacatcatcttccatgacttggacgggcacttccttgacaattcctattggcatcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattgg

SEQ ID NO: 146023 - DNA, 7864 bp, Homo sapiens
  Payload ID: 8956
  Gene Symbol: KIAA1671
  Gene Name: KIAA1671
  Uniprot ID: Q9BY89
  ENST ID: ENST00000406486
  CDS Start-End: 388-5808
gcgggcaggtggcggcgcggcgcgggctggcggtggctccacgacagggtcttactctgtcacccaggctggcgtgccatggtgcagtcatagctcactgcagcctcaaattcatgggctcaagcaattcacctcagcctcccaaagtgctggaactacaagcatacaccaccatacccaacctgctgaaactcagcctgctgggacgagtcttctttcccccttcttgtttctgccatggaagtgtgtggacagccccattcatgatgacatgtgacactactggcttttcccggcagtcacaccccctgacccagggcctgccagcttggcaattgcttctccattcttgaagttcctaacccccatgaatccacaaccataaccatggccacgcgggtcgaggtgggctccataacgcccttgacggccgtgccaggcctgggtgagatgggcaaggaggagaccctgacgaggacctacttcctccaggccggcgaagcctctggggctcccccagcccggatcttggaagcgaagagccccctgcggagcccggcccggttactccctctgccaaggctcgcccccaaacccttctcgaaggagcaggacgtgaaatctcctgtcccgtctctgcggcccagttcgactggaccttccccctctggggggctctctgaggagccagcagcaaaggatctggacaacaggatgcccggcttggtggggcaggaggtgggcagtggggagggcccgaggacgagctcgcccctcttcaacaaggctgtgttcctgcggcccagctccagcaccatgattctcttcgaaaccaccaaaagcggccccgctctggggaaggcggttagtgagggggcggaggaggccaagctaggtgtgtccggctcccggcctgaggtggctgccaagcccgccctgcccacccagaagcctgcggggacccttccccggtcagctcccctgtctcaggacacaaaaccacctgtaccccaagaggaggcaggccaagaccatcctccctcaaaggccagcagtgtggaggacacggcacgcccccttgtggagcccaggcctcgcctgaagagaaggcccgtgtctgccattttcacggagtccattcagcctcagaagccaggccccggcgcagcggccacagtgggcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgttttcaagttcagcttccagcaacgaagtcaaatatgagaagagtgctgagctgagcggcgagtttcctaaggaaccgagagaaaagcaaaaggaggggcacagtttggatggagcatgcatcccgagaagcccctggaagcctgggacactccgggataagtccaggcagacggagcagaaggttagctctaaccaagaccccgacagctgtcgcggtggaagctcagtggaggccccgtgcccttctgacgtcactccagaggatgaccggagcttccagactgtgtgggccacagtatttgagcaccacgtggagagacacacagtggctgaccagtcgggacgttgtctctccaccacaccccctggtgacatggcccatgcccgtgtctcagaacccaggccgaggcctgagatgggctcttggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaatcacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggcctgtccatcatgcatgaagccagagagaggaggcgagagcagcccaaagggaggcccagccttactggagagaatttggaggccaaaatgggaccctgttggtgggagtcagggactggagacagtcacaaggtgctgccacgggacctggagaaggaggatgccccccaggagaaggagcgaccgctccagcaggtgtcccctgtggcctcggttccctggagaagccacagcttctgcaaagacaggaggagtgggccctttgtggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttg

SEQ ID NO: 146024 - DNA, 6386 bp, Homo sapiens
  Payload ID: 8956
  Gene Symbol: KIAA1671
  Gene Name: KIAA1671
  Uniprot ID: Q9BY89
  ENST ID: ENST00000401395
  CDS Start-End: 398-1339
gtgcacacattcagttcccgggcatcaccttctctcttcttgccttcttgccgtacaactgaaaaccctaaaaccctccgtgcctacggctcccgggagggtgagggtccaggcagctgggttcagaaggatccacccctggacccgccccactggacgagaagccagagatgccccgggcggggctcataggaccgagtggtggcttctcagttccccaggcagccgtggccattagtggagccgactggctggtcccctggccgtgagccggcttctgaatgatttatgccgccttgaacttgactccagcgtgacaggagtgagaagagccgctcccgctagaggaaagctggaaaccgtactgtgctcaccacataacctctgggtgctggaaatggagtattactactgccccagcctgctgaagctcttgcgctacctctgggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggctacctctcaggagttcatttgtctctctgtctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagatcatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtcgaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttcttcatggtcctttgcctaatcaaacagaggcttttggcctttgaaaatccatgacaaggcctcagaaatcagtgttgtggaggattactccatgccaccggagaaactctggtgaaagagaaacctcgtggtctttaggatgttgggattttgagtgaacctgacctgatagcctcaggattcagggaaaggacaatcagatggcggtgttttccagggggacgcgccaaatcatgtggtttcagacaattgtgtttgcctttgtgcctccctggaagggaggccaactaagggtatcaccaagaagccaaaagagaaataggcatgagcctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctggaactagtcgtaattgcaaactgtaaaaatccctcctccccagtgtagatatttaaaccagagtaagtgatggggagacattctgtggtctctgaatgtgccttccccctcaccgtgtgttaaaacacaaaagccgaagttccatggcatcatgattccgaggggctggagggataggacccactccacatctaaaggggatctgctttgggctcggtcccattagcgagtgggggactcttgctgtgtgctaagaggctgctaggactcacccagttggaattctgggtgggctcaggaagtttagagccacgtaaaaagctggtaggcatgagtgtgccaggtctttgccagcctgcgtctccttttgcaccccccaatccagagtttgctttcttttgactaaattggctcctgcagggggaagggcagaaagctaggccctctgctctggaaagtcggcctgaggtttccggcaagttaacccttaaaatggacacccctcagcccgccctcccctttggccttcccagaatctccttcagtggttgctctcacacctgtgccataacatcatcttccatgacttggacgggcacttccttgacaattcctattggcatcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattggagaa

SEQ ID NO: 146025 - DNA, 4402 bp, Homo sapiens
  Payload ID: 8957
  Gene Symbol: KIAA1683
  Gene Name: KIAA1683
  Uniprot ID: Q9H0B3
  ENST ID: ENST00000392413
  CDS Start-End: 217-4320
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacggtaggctccctgctggcctccttgtgtgctgaagtagctggtgtgctggcatcccaggaggatctccgcactctgttggccaaagccctctcccagggagaagtctgggcagctctgaaccaggccctgtccaaggaggtcctgggtgccactgtcaccaaagccctgccccagagcatgctgagcatggcgctggtgaaggcgctgtcctggagtgagctgcgcctgaccctgtcccgagccctgtcccggggcgagctgcgggcggaactcaccaaggtcatgcagggtaaattggccgaggtgcttagcaaggctttgacggaggaggagtgggtggctctgagccaggccctgtgtcagggtgagctgggtgctctcctgagccagtcttggtgtcgggtggccctgaggactggaaccatcctccccaaggccgcctcgaaatcaacaggaagcggggtgactaagacgccggccctggtgaaggtggcctgcaggaggagtccatcggccgcatgggggccctccctgggccccgtgagaccacagaccagcaagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagccta

SEQ ID NO: 146026 - DNA, 3819 bp, Homo sapiens
  Payload ID: 8957
  Gene Symbol: KIAA1683
  Gene Name: KIAA1683
  Uniprot ID: Q9H0B3
  ENST ID: ENST00000600328
  CDS Start-End: 195-3737
aacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagccta

SEQ ID NO: 146027 - DNA, 3871 bp, Homo sapiens
  Payload ID: 8957
  Gene Symbol: KIAA1683
  Gene Name: KIAA1683
  Uniprot ID: Q9H0B3
  ENST ID: ENST00000600359
  CDS Start-End: 385-3789
agggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggacctgctacaccctgaccaccccctgccgcccccacaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagccta

SEQ ID NO: 146028 - DNA, 533 bp, Homo sapiens
  Payload ID: 8957
  Gene Symbol: KIAA1683
  Gene Name: KIAA1683
  ENST ID: ENST00000599528
  CDS Start-End: 511-533
agactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaagaaaagtagccagccaggcatggtggcgtgcacctgtaatcccagctactcgggaggctgaggcaggagaatcgcttgaacccaggaggcggaggttgtggtgagccaagatcacagcattgcactccagcctgggcaacaagagcaaaactctgtctcaaaaaaaaaaaaaaaaagaaaagaaaaaagaaaagcaggacctgctacaccctgaccaccccctgccgcccccacaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagcc

SEQ ID NO: 146029 - DNA, 537 bp, Homo sapiens
  Payload ID: 8957
  Gene Symbol: KIAA1683
  Gene Name: KIAA1683
  ENST ID: ENST00000593659
  CDS Start-End: 472-537
agactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaagaaaagtagccagccaggcatggtggcgtgcacctgtaatcccagctactcgggaggctgaggcaggagaatcgcttgaacccaggaggcggaggttgtggtgagccaagatcacagcattgcactccagcctgggcaacaagagcaaaactctgtctcaaaaaaaaaaaaaaaaagaaaagaaaaaagaaaagcaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacag

SEQ ID NO: 146030 - DNA, 535 bp, Homo sapiens
  Payload ID: 8957
  Gene Symbol: KIAA1683
  Gene Name: KIAA1683
  ENST ID: ENST00000595654
  CDS Start-End: 253-535
caggggcagcccagggcagtgttgctgcatattgcatggatgaaaggctgaaggctgcctcctcttgcaggctggcttctgagattgcaccttcttctcctgctactcctccaaatctatgacccttcaagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttca

SEQ ID NO: 146031 - DNA, 632 bp, Homo sapiens
  Payload ID: 8957
  Gene Symbol: KIAA1683
  Gene Name: KIAA1683
  ENST ID: ENST00000608950
  CDS Start-End: 183-632
acaaagctgctgcggcaccagggctccaagactggccgttcagactgctaggtttagcttcaggggcagccagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaag

SEQ ID NO: 146032 - DNA, 2684 bp, Homo sapiens
  Payload ID: 8957
  Gene Symbol: KIAA1683
  Gene Name: KIAA1683
  ENST ID: ENST00000612316
  CDS Start-End: 217-2601
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctag

SEQ ID NO: 146033 - DNA, 7610 bp, Homo sapiens
  Payload ID: 8958
  Gene Symbol: KIAA1715
  Gene Name: KIAA1715
  Uniprot ID: Q9C0E8
  ENST ID: ENST00000272748
  CDS Start-End: 249-1535
agcggcgcgcgccgaccgcggcgccaattggcgagcggctggagcgcggggtttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccattgcttagaccctttaatgactcttgagtgttcttgggatgaggtccaaatttactaataaggcctgcaaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaatacaaacaagaataaaaattgagtacagaat

SEQ ID NO: 146034 - DNA, 528 bp, Homo sapiens
  Payload ID: 8958
  Gene Symbol: KIAA1715
  Gene Name: KIAA1715
  ENST ID: ENST00000392540
  CDS Start-End: 187-528
ctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggagggtaagacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaata

SEQ ID NO: 146035 - DNA, 2028 bp, Homo sapiens
  Payload ID: 8958
  Gene Symbol: KIAA1715
  Gene Name: KIAA1715
  Uniprot ID: Q9C0E8
  ENST ID: ENST00000409660
  CDS Start-End: 317-1234
ccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaa

SEQ ID NO: 146036 - DNA, 639 bp, Homo sapiens
  Payload ID: 8958
  Gene Symbol: KIAA1715
  Gene Name: KIAA1715
  ENST ID: ENST00000445472
  CDS Start-End: 391-639
ctttttgacgtccaagagtgacagagcctcaagcactcctggggaccgggctgacttttctccactggcttggttgggaactggcttcttcggagctgtgtagtcttaatttgctttgctgctggctggctgacagctgatgggggactcctcaggacggactcccttccagatgcacccatctccatccttctcaactccccaacctttgtcctccccactcttcgctcgcgcggcggtctgagaccaccaggaccagtttcaggggtttccttctccagcgagacttggcagaacaggctttaaaagcaaaggaggcagcggaagactgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgctttt

SEQ ID NO: 146037 - DNA, 539 bp, Homo sapiens
  Payload ID: 8958
  Gene Symbol: KIAA1715
  Gene Name: KIAA1715
  ENST ID: ENST00000431754
  CDS Start-End: 1-210
ggatcccctgctacttcagtgcctggaatgggtcttcatcctccaggtccacctttagcaagacctattctcccccgagaacgaggtgctttggatagaattgttgaatatttggttggtgatggtccacaaaacagcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagt

SEQ ID NO: 146038 - DNA, 7647 bp, Homo sapiens
  Payload ID: 8958
  Gene Symbol: KIAA1715
  Gene Name: KIAA1715
  Uniprot ID: Q9C0E8
  ENST ID: ENST00000544803
  CDS Start-End: 198-1577
tttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatggagatggggcttcctcatattgcccaggctggtcttgaacacctgagctcaagtgatctgtctacctcgacctctcaaagtgctgggattacaggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagctgtaaactcatctcttttccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaaaaaagaaagaaagaaaatgaatctgccacgccattgcttagaccctttaatgactcttgagtgttcttgggatgaggtccaaatttactaataaggcctgcaaagccctgtgtaattttgctcctagttatggctggcatctgcaccacaactacagccactgccacctccccctgccacacacacattttaaaagtaacaatagtagtgttttctgtgttttgcatatgcagtcttttctcatctcccagccttcttgagcttttcctctgcctgagatacgctcccactcacatagacattgggggcactaaataaaaatagctgtttaattgaattggaatcgttccacttggaacccaagtttggaaattttgctacttcttgttaagctaggccttttattcttgaagttgctatttctcatacaaactcattttatgcattagacacacagtcactattgttatggagaacatagttgtatcagaagaggtatagctttgggtgtggatgtgcgtgtgtcaggggaaagatattctgattatatgatgattttcataaaatatagtatgctgagtttccgaaaatcctaaatgacttagaaatggtgctatatgtggtttgtttgacccctgcaaatctcatgttgaaatttgatccccattgctggaggtgttttgagcatggagcggatccctcatgaatgtcttggcgttgtccttgcagtaatgagttcttgctctatttttcctcccctggaagctgattgtttaaaagagcctggtatcctccctccctttcttctttgcttcctctctcttgctgtgtgatctctgcacacaccagctcccctttgctttctgccatgagtggtctgaggctctcaccagaagccaagcagaggctggcaccatgcttctagtacagcctgcagaactgtaagccaaataaacttcttctttgttttttttttttgtttgttttgtttttttttcagtaaattacccagcctcaggtattccttaacaacacaaatgggctaagacacagggtcatagggatagcaggcacctgagccaagccagaacttagatctcaactgttaatgcaggatgatttgtattgaaccatgaattttacactgcctctcaatgttggtgtcagcatttaaggttatttaaaaaatacaacctgaaggttacataaagtttcatttaaaaaataagaccttataagtctacttttatttccagtggacagcaactacttaatcgtcttaaaactttcttcttacaatattactttacaatattacctgttggatttattatctgtgtacaaatcagttagttgaagggccaaagaataaaggcattttgtgaattatgaatagctattttgaaatggtcatggagactagctactctagaaaattgggagaatatactgtattaagttactatctggtataacttcaattaattgtgaaaattgtagcagagatctagatatagtttatgaacttctaaagagacattaaagggaattcaagtacttgtgtaaagatgaaccaaggtagagatgattgtgaattggtgatctgctgtatgttacagttatgtaatttgacttgtttcaaaattattaaagttttaagtgtatgcattctactggtcaataagtaaatatattcaggctctgaatgtagacagataaatatataaatatagaaagtacatttgttagaatacaaacaagaataaaaattgagtac

SEQ ID NO: 146039 - DNA, 6429 bp, Homo sapiens
  Payload ID: 8959
  Gene Symbol: KIAA1755
  Gene Name: KIAA1755
  Uniprot ID: Q5JYT7
  ENST ID: ENST00000279024
  CDS Start-End: 273-3875
gtctggtggcccgacccgcgccgcccgcggctcccttatgtctctcgccgtctccagcctcagtccctctctgtctctctctcagtctctctccctgtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagaggatgacctggttccacatggactgtcaggacctgatggcccagctcaggctggacaagacctcaagggtcagtcctggggaccagcgccgcctccaccgctacctgcagcgactggcatctgagttccctgctgagaagctcgcagccgtggggctgcaggtggcctccctgagccgggcaggcctgggccaggagctatgggaggaggcccggatcaggcatgaggagatccggatgctcctggagaaggcactgacccacagctcttgcccagaggctccagctgctcactcagcgcgcccagaacgaagaggggtggcagccaagggccagggtgtgagtgtagaggtcacttccaaggggaggtgggatcagcctccactagactcactgggcatggaccatttgccaaagtcctattggcctcctgggccccccagaggggaacagaacagaactttccaggcaggctctccaccccaggaagctggccaggctgcagaggctgaagacggcaaaggctcccacaagctgcctgaccctgcccgcgagcatttgcttgccaccaccttcttccggcagcagccccccaggcagagccaggtccctcgcctcactgggggcagcttctcctcagaggggacagactcacagacatcccttgaggactcaccccagacaagtccccttgcctccctctagctgagaggccccttcagtcgcaccagcctccaggagcactgggccagggcccagctggaggggtagctgggagctctggtcagtcccagtgagacgtcaccatggagcactggttttacattctgcctctgctgggaggatgagaactgtcgacctgcccctggctccagaaaactcctggaagacccgatcttcacccatgcagaatagcaagagtgggcgtcagaaccagggcacaataaatggtgtgattggctccatccctccaggctctcattgtggaaagacctgtcggcacagacccctccagaggtctcgctcgcaggcaggcagacacccacctgcagctcaggaacatacacagctctcccctcgggtacgagggccagtgttgcccttaggcagaatcctcggggagattcgggagtgcttccttgtcttggattccaggaaaatggaccctgagatgaggatttaaggatcagtgtgtttggtgctgatccaggaacctctgctgggggagtaggaggcgaatctgcaaagggaataaagagtatgttgtcaagcaaattttcttttttttaatttttaaaacttcattgtattttatgtttagagatggggcctcactacattgcccaggctggtctcaaactcctgggctcaagtgatcctcttgccttggcctgccaaagtgctgggattgccttttccgcccaccccccccgaccccaccagagacagggtctcactctggtgtccaggctggagtgcagtggtgcaatcatagccttaaattcctgggttcaaccaatcctcccacctcagcctcctaagtagctgggactacagttatgcaccaccatgctcagcttattatttatttattttttgtagacatggggtcttgctatgttgcccaggcaggctgatctcaagctcaagtgatcctctggactcagcctcccaaagtgctgggattatacgtatgagccactgtgccccaccctcatacaaatttccatgttggcaactgtagctggatctttctggagatctctgaaagacagcatggaatccttgaacaccccctgaggcgtgaggcatccagagcatttatctgccaaccctcaggagctggcactcgtagacagcacgcacagccagctccattggtcttggcaaagagaattgcctcctggagccagaggccggttcctgtgcttagaaaggaaggacatgtcttctgtgctccctgtctcacaaggcctcttcagcaggcatgggaccttcattctcaagttcaaggaaccctgtggaaccttgtccttgtcctccagagagaatcctctccgccttagaggtccctcctctctctcacctccccaccaagcctccctgaactcaatgtcttctgtccccttccctgcccaacttccacttctctatgcccagcctctgtggcccagtaccattggggttctgtgggcagctgggtcctggtggttggggaccgtgggaaggggcctatctgtcggatcttagatggagcatccagaagccccacccttcatactggccagagtggcccctgccagcgcctctctggagtgtcattaagctgaaagtgtttgccttacctctgcagtaggatgcattactgaagtggcctcttggtcacctagctctgaattttcctggctccagaaagaggctgtggggcacaggtcccccacaatgaggctgtgaaggggagagaggcaggcctgggccaggcacaggaggacaactagggcttctcaggagctgtctcagccaagagtcacacacttgatacctaaaatggcttcaggaatcttccaagactgaagacttccccaggtgtggtctagggcctgcctgcctcagagccatgagcagagccggtcaaaaggcttcctagggaatcctaccccagacattaaaatagactcttggtgctggcaggtggctggaatctgcgtttgtagccaagtgctcttcctgtgtgactcagcaaagtgggggtgcatttggggaacacccggggctggggcctgagtcctccacccaaagccaggtttgattcttgcattcccctccctgccttccatccagacaggcccaaagatgcaagaggcgttgatcagcccatctccatccatgcctgttgcctcagagagggccgacggcttttaaaatgctgttgccatagcaacagcatccagccagtgggtaccacaggcagggagccacagaaactggggtgctgggatggaaactgacttgtgagagaccacagctactgctagaaggaaggggggcaaagcgggcacaggtaatctaagaatacttgggcgggaggagtccccaaggttaccttgtgcatccctctgtccccagaaagaactgtaccccaacaatctctcccctcactgcatcccctggggaagaagggaatgcagaaatgaaatgtcataatgagtaacaatgtataaaaatatcgaataataacagctaacatttcttttgcatt

SEQ ID NO: 146040 - DNA, 798 bp, Homo sapiens
  Payload ID: 8959
  Gene Symbol: KIAA1755
  Gene Name: KIAA1755
  ENST ID: ENST00000435901
  CDS Start-End: 1-798
cgggctattctcttcctgggggagaaggaggcggctctccagctgcagacattacctgacgtccagaagctggaccctttccttgctgacctccaccaggcctcttccctgctacaagcttccatcgaggaattcgagaaggccgacccccctggggggatgcaggaggctaccaggtgcctgagcaagtccaaggagctgatggaggctgtgctgagggaccccggcctactgggcctccagcgggaaggtggagccaccctggccaggctgcagcatgatgccagcaggctggacttcagccctgatgtcaggagccatctggctgcagccactgccttgtacagccttgtggacgagcagcttcatgttctggtcaccgcttccaacagcctcctggggaagctggagctccgtgtccgcctgggccgcctggaagctgccattcaccaggtcagcgactggatggagcaggaaggaaggcggtgcctgcaatcactgacccccaaggatggaagtttggagacagtggagaaagcccacgcagaatttgagaacttcttcctccaggctgcagcccagtaccgccgaggcctggagctgtccaagcaggccgctcagctgggagctacagccagaggggctggggaggcagaacgtgcagagttcccagagctggcagcctttgcctctacccagcgggccttccaggctgagctgacccacttttacatggcggccgagcggcaacgcacggacctcgagacgctgctccacctgcaccgcttctgcaagagg

SEQ ID NO: 146041 - DNA, 208 bp, Homo sapiens
  Payload ID: 8959
  Gene Symbol: KIAA1755
  Gene Name: KIAA1755
  ENST ID: ENST00000611812
  CDS Start-End: 1-116
ccccagggcctgagcccaggattggggctctaggtgtcaaggttttccgctccaggatagcatgcctgccaggatcatctttcctctttggctctgggccattcccatcaggatgagaacacgctgcaatattgcccagcttgaaatgagctattctaggcccccgtgttcccaccctcacccttttacattaaaactccacaaagca

SEQ ID NO: 146042 - DNA, 2557 bp, Homo sapiens
  Payload ID: 8959
  Gene Symbol: KIAA1755
  Gene Name: KIAA1755
  ENST ID: ENST00000496900
  CDS Start-End: 273-2471
gtctggtggcccgacccgcgccgcccgcggctcccttatgtctctcgccgtctccagcctcagtccctctctgtctctctctcagtctctctccctgtcctccccggccgctcctccgagatgacgccggggtcggtgccccgggcctgccctatcccctggctccagggctaggcgggaccgagggctgccccagacagacggacccgcggacccacagaccccgcgcccaggagaggagccgcgccgcccgccgctggcagcccgtcaccatggaccctccatccctcgacacagccatccagcatgccctggcgggcctctatcctcctttcgaggccacagcacccaccgtcctgggtcaggtgttccgtctcctggactctggcttccagggggatgggctgagcttccttctggatttcctgatccctgccaagcgcctgtgtgagcaagtgcgagaagcagcctgtgctccctactcacactgcctcttcttacacgagggctggccactctgtctgagggatgaagttgtggtccacttggcacccctcaaccctctcttattgcgccagggtgacttctacctccaagtggagccccaggaggagcagtctgtctgcatcatgatcaaatgcctctccctggacctctgcacagtggacaagaagcctgttccagagccagcctaccctatacttttcacccaagaatggctggaggccatcaacagtgactttgagggaaatcccctacacaactgcttggtagcatcagaaaatgggattgcccctgtgccttggaccaagataaccagcccagagtttgtggatgacagaccccaagtagtgaatgccctctgccaagcctgggggccccttccattagaggcactggatttgagcagccctcaagagttgcaccaggccagctccccagacaaccaggtgcttcctgcccagagtttggccaagggtaagggcaggacatatgggagcaagtatccaggactcatcaaggtggagcaagcccggtgtggggaggtggctttcaggatggacgaggtggtcagccaggacttcgagggagactatgtggctctcctaggcttttcccaagagagcagaggagagtctcccagtagggaggcaggcacatccagtgggtgtacttctggggcactagaggagatagctggaactaaggaaactcccttatttcaaaagatactgcctctctcagaggccaatgaaggaccttccttgggaaatcgggcttgcacaaagccagaaagctctgaggagaggccctataatttgggcttcaggagaaaggtcaatcttaaagcacccacccacaactcagaaaggccgccccaaggctcctacatgaatgtccttgaggacgcactggactgtgcctctggtctcagggcaggtgtctcacaagagccagctgcctccaagatgcagggacctctaggaaacccagagaatatggtgcagctcaggcctggaccaagacaagcctcctctccccgcctgtccccagcttctcctgcagctgcagcctctgaaacaaagatagaggtgaagaccaaagagagaaatgggagacttcccaagcccatgccctgccctagcagaaacacctcctcccctgagccccccactcctgggctcaaattctcattcttgagagggcagaggcaaccctctgtgaccccggagaaagcctcactccagcacaatgggccctggaaagtcctgtgttccctctactctcctaaacccaaccgagccaaatctttggggaaagctggaacaactcagaccaaaacatctggcccagccactgcccccagcccactgactgaggaaaaggctgccttgccagaagcttctgcaggctccccagaaagaggccccaccctggaggaggagcccccagggcctgagcccaggattggggctctaggtgtcaaggttttccgctccaggatagcatgcctgccaggtggccgggacagggccgggcggcccctgcttctggtgtcaactacagagggggcctgggaggcaccatggtgcacagtttcagaggtcaccaagctactgtcctacctgtgtaccatccccaggcctgaagataaagccaaggggctggcggtcctgattgacgccaggagacagcccccacagcccggtctggtcagcgccctgcaggccacccaggctcaggtcccagcctctatccgggctattctcttcctgggggagaaggaggcggctctccagctgcagacattacctgacgtccaggtggaggtgctgacctcattgaaggccctcagccaccatgtggaccccagccagctgcccgcagtcctggaaggccccttcccctactgccacaccgagtgggttcatttcttccaggtgtttaccgtcacagcctttagcccctgacccccactccttctcttcttctcttcactcttctgtcccatggatccatcaaccctgctatgctaaaaaataaacggtcactcaac

SEQ ID NO: 146043 - DNA, 3116 bp, Homo sapiens
  Payload ID: 8960
  Gene Symbol: KIAA1841
  Gene Name: KIAA1841
  Uniprot ID: Q6NSI8
  ENST ID: ENST00000295031
  CDS Start-End: 378-2501
acccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatcgtgaggcagagacacaaagatatggaagaacattggacagatttacatcgatatattaattaaggtgatttcagagttggagcaggagaggaagccttatagatatttttttttctttttgcttgcttgtattttctttttaattattattcagtatttcaagtagacagaaaagtacagaggataatacaacaaatatccaggtacccaccacccagcatttttacatagtagcatttgatgttttgaaataagacataaaacattccaaataccctatcaccgaggatcctgcatcctcttcttttcccagaagtgaacatttctctgaatttgatgcttattatgcccatgcatgttgttatacttttactacatattttatgtagctacagcataatatgctatgtttactttatatagtgacctcatactatacatatcctcatgcaattttttagactctgtttgagaattatatattttgattcaggtagcttaagtttattttagctactcagtagtaatgtattctattaatctactaatatatatttcttgtctatggaca

SEQ ID NO: 146044 - DNA, 2149 bp, Homo sapiens
  Payload ID: 8960
  Gene Symbol: KIAA1841
  Gene Name: KIAA1841
  Uniprot ID: Q6NSI8
  ENST ID: ENST00000356719
  CDS Start-End: 26-2149
tcttccctatccctagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaa

SEQ ID NO: 146045 - DNA, 4516 bp, Homo sapiens
  Payload ID: 8960
  Gene Symbol: KIAA1841
  Gene Name: KIAA1841
  Uniprot ID: Q6NSI8
  ENST ID: ENST00000402291
  CDS Start-End: 242-2398
gggctcggtagcggcagcttcagggcgcgagcgcgggcggtgccgaccactgcaggtaacagaggcgctgcgagggcagccgcggccctgtggagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaaaa

SEQ ID NO: 146046 - DNA, 4472 bp, Homo sapiens
  Payload ID: 8960
  Gene Symbol: KIAA1841
  Gene Name: KIAA1841
  ENST ID: ENST00000453186
  CDS Start-End: 295-645
agccgcctgcaagcgggcgggggcggggtgtgaggcgctgcggacggggttgcgggctcggtagcggcagcttcagggcgcgagcgcgggcggtgccgaccactgcaggtaacagaggcgctgcgagggcagccgcggccctgtggagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgaca

SEQ ID NO: 146047 - DNA, 4294 bp, Homo sapiens
  Payload ID: 8960
  Gene Symbol: KIAA1841
  Gene Name: KIAA1841
  Uniprot ID: Q6NSI8
  ENST ID: ENST00000453873
  CDS Start-End: 26-2182
tcttccctatccctagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatg

SEQ ID NO: 146048 - DNA, 4202 bp, Homo sapiens
  Payload ID: 8960
  Gene Symbol: KIAA1841
  Gene Name: KIAA1841
  Uniprot ID: Q6NSI8
  ENST ID: ENST00000612149
  CDS Start-End: 370-2088
tcttccctatccctagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaaaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatgcatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttaaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgtttctgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgac

SEQ ID NO: 146049 - DNA, 5958 bp, Homo sapiens
  Payload ID: 8961
  Gene Symbol: KIAA1919
  Gene Name: KIAA1919
  Uniprot ID: Q5TF39
  ENST ID: ENST00000368847
  CDS Start-End: 354-1910
gcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagccgccgagctggagttagaggtggagctccgtggggccgggcccccggctgcggggcagcggctcctgcaggcggaggccccggcggagaatgagccggagccggaggtggtggtggtctcctggcagagcggtgggaccgggagcaagctgcggtggttcaccaccttgatgctgtgtgcctccttcctggggctgggattgagtgttgctatagtgggacccacgtttcaagatttggcaacaaacgtgaaccgaaatatcagtagtctgtctttcatttttgtgggtcgtgccttgggatatttgagtggctctgtgattggtggatttcttgtcgatgtcatgaattattttttacttttgggaatctcaatgtcggctaccaccgttggtctttatcttgttcctttttgcaagacagcaatattactcactgtcatgatgtctatcttcggtgtttcaattggcattctggatacaggtggtaacgtccttatcttggctatttggggggacaaaggagccccacatatgcaggccttacacttctcttttgccttgggtgcctttttggctccactgctagctaaactggctttgggtccgacagcgtctgctgaaaaccacacagagtctgacttccatcctgcactcaaccaatcatctgatgctgactcagaagctctgtttggagtacctaatgataagaatttactgtgggcttatgctgttatcggtacttacatgttcttagtttctgtcatttttttttgtctgtttttaaagaatagctcaaagcaagaaaaagcaagagcatctgctgagacatttcgaagagcaaaatatcacaacgcccttctttgtctcctttttctgttcttctttttttatgttggagctgaggtaacatatggctcttatgttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggtgcagtggctaaagcctgtaatcccagcactttgggaggccgagacgggcagatcacgaggtcaggagatcgagaccatcctggctaacacagtgaaaccctgtctctactaaaaatacaaaaaattagccaggcgtggtggcaggcacctgtagtcccagctacttgggaggctgaggcaggagaatggcgtgaacccgggaggtggagcttgcagtgagccgagatcatgccacaccgtactccagcctgggcgacatctagactccgtctcaaaaaagaaatggagaggtatttttattaattgctttaccttatctgtagggttggatcaaagaatgtaatgactcatttgatttctaatttcaatgaagagaacacagaacagggcccaaggggtcgggcttcaagccttgacttcttctagccctgcactctgtcacttaacgtaggccttgtttatctcgcctcctgatctgtgattctagaaatgaaaatgagatgatttccaaattgggaatctgtaagttttaaagtttgtgcaaaatgtctgctagaaattagtacaagtgacagcatgttcttcatttcaaatgagaagtgaaaccaaaatgataaatagctttaagaatgtgctaatgataaatgattacatgtcaatttaatgtacttaatgtttaataccttatttgaataattacctgaagaatatattttttagtactgcatttcattgattctaagttgcactttttacccccatactgttaacatatctgaaatcagaatgtgtcttacaatcagtgatcgtttaacattgtgacaaagtttaatggacagttttttcccatatgtatatataaaataatgtgttttacaatcagtggcttagattcagtgaaatacagtaattcattcaattatgatagtatctttacagacattttaaaaataagttatttttatatgctaatattctatgttcaagtggaatttggagacactatgttctaattttaagaactgtttcagtgttattagattagtagtagggctgtagatggggtctttcgaggtcctttgcctacctcagtaacagaggctgggtctgagccttgctcgagattagctcttcaccaggtctgtgtggtaatcatatcgtagttaccgtaggtcacgctgcaagtgtaatttacagtgaggcatagtcttttccagtgattggaatacttgtgtcaccgatccagggtttctctttcctgagtctgaaatacctgggaaaccagttagaaggtgactgggtagcctaggagtcaaggatcagaaagggtacttcatatatatgtggcagaattggtgcaggtgatcctttgaaaaatgacaagaattgatgaaattttgtttacttcctccaattttttgctgaataacatctcctttctacctgattggagtaggcttgctttctcttacttaatttctataaatttgccattgttttgtctcaagtaaaatacagtgtctttcttgaccactgcccgcccattcaccttatatgcctgccacagtcttggttcatgtaataacctaacagctttggagatggcggtggagaagttaatggtaaaaaccttcttgctctttttatttttatttatttattaggggtgggggatggtgtctcactctgtcactcaggctggagtgcaatgacgtgatctcagctcactgcaacctctgcctccctggttcaagcgattcttctgcctcggcctcctgagtagctgggattacaggcatgcgccaccatgcccagctaatttttgtgtttttagtagagagggggtttcatcatgttacctaggctgatctcaaactcctgatctcaagtgatctgcccacctcagcctcccaaagtgttgagattacaggcatgagccactgtgcccagcccttttgctctttttatagtgtaaatttccctcagttagaacttggaaattacttctgcttcacttactgccttttctcaggttgttggaatctaggcagtagcagttacttggcagctaggaggcttgctagaataggaattccaccttcagcatttactgttacagggtagaagatgcagctcagggagagaaggatgatgataagaacatggcagaaaatctcaaaatctactctggaaaattcactatgtttccacacaccaacatgtgaatcgtcatgagatcatagggcattgttaaagttccatattggaaggaaaagacttagtacaattctaagaattagcatttatcctgctgatcagttcttagctaagtgtctgctgatacctaagtaaccaatatacccaagtgttctattgctgggtaacacagtaccacacattgaacaccttaaaacaatagacatttggtaatgtctgtacaggctgtactgaagcggcctgtacagggccgcttcagtacaggaccttacctatgtagactgaggtacgtgtttcttgctgactgtcagctgggcaccactcagcttcgagaggcctcccacagttcttgccatgtggccttctcacagatgcctctcacaacatggcagtttcttcaaagcaagcaggagaatctctaaatgagtcttgtatgacattacgtcattatgggaataacatcccatcacctttgccatattctagcgtctagaagcaaggtatgagttccaacaaaactcaagggtagaggctagaacagggatgtgactcattgcggatcaccttagagcatgcctgccacactcgggtacctgcagaatagagattctcaaaagttctaaaaactgagctaagagcaggacatgatggctcacacctgtaatcccagctactcaggaagctggggtggaagtatctcctgaggtcaggagtttgagaccagcctgggcaatatagtgagacctctgtctctaaaaaatttttaaaagagaccccttctctaaaaaacaggaaggctgggcgcggtggctcacacctgtaatcccagcactttgggaggccgaggtgggcggatcacaaggtcaggagatcaagaccatcctggctaacacggtgaaaccccatctctactaaaaatacaaaaaattagccgggcgggcgtggtggcgggtgcctgtagtcccagctactcgggaggctgaggcaggagaatggcgtgaacccaggaggcggagcttgcagtgagccgagatggtgccactgcactccagcctgggtgacagagcgagactgtctcaaaaaaaaaaaacaaaaatattcaactatgagctggggaaaaaagcttcagcggtcactgaaagtgcttacaggtacagctagtatggggatggaatatgccccattagccaggccaacagatctcatataggagaatctgttttatgtttgttggacagtgggtgagttatcgcagagttatgccttttttttctgtcactattttatgtcccttatcactgtgcctttaacctactgaaatgcagttgaggccgggtgcggtggctcacgccaagatggcgccactacactccagcctgggcaacagagggagactccatctc

SEQ ID NO: 146050 - DNA, 11775 bp, Homo sapiens
  Payload ID: 8962
  Gene Symbol: KIAA1958
  Gene Name: KIAA1958
  Uniprot ID: Q8N8K9
  ENST ID: ENST00000337530
  CDS Start-End: 297-2447
tccgagccgggcgcgcggagctcggggcgcacggagcggcgcgcggcggtcggccgagccaggctggcgcccccgccccccgccccgctcctcggtccgccgcccgccgggcgccttccccgctccacttacctttggtgcccggccctctggccgctctcctcccgccctcgcgccccttcggcccgtcccgtccagcccgggctgcccggctctcgcaggcccccccgcgccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagcttattccactaagctcaacaaatttcctgtatttaatattaatgatgacttgaatgatctgtgtaccagtgcagtaagcccaaatactaccaaagccacgcggtacgccttgaatgtgtggcgttattggtgcatgaccaacgggctcaaagaccacacagacatcaccaagatccctgcagtgaagttgaacgagctgctcgagaacttttatgtcaccgtcaagaagagcgacggctcggacttcctggccacctcgctccatgctattcgccgaggcctggaccgcatcctgaagaatgcaggtgtcggcttttccatcaccagcagcaccttcagctcctccaccaagaaactcaaggagaagctgtgggtgctgagtaaggcaggcatgtcgggcgcgcgttctcgcaacatcgtctacttctccctttctgacgaggaggagatgtggcaggcagggtgtctgggggatgacagccctatcactctcctgtccactgtggtcaagtacaacagccagtacctgaacatgcggacgctgcaggagcatgcggatctgatgtatggtgacatcgagctgctcaaagacccccaaaaccagccctactttgcccggacggacagcgtcaagcgggagagtcggagcggctccaccagagtgtgtcacgggaagatctaccatgagcattcccggggacacaaacagtgcccttactgcctcctctacaagtacatgtacatccaccggccgcccacccaaatggaggccaagtcccccttctacctgactgccaggaaggaggccacagacatgggcagcgtgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctggagctccttggaggcaggggctgaccaggtgtgacctcccggtctggcggctctcccctggtgtggcctgccctccctttgacttggggtttgctttttaaaatgaaactagatgagtctaaatcattcggatggtttatccaaatgtgcgtcaacttcgttagcttttagaatctaacacaatgtataattgttacatacaagagtgaggaaattcattttctctagtgcctttctagcacaggttttctcaaaacaaacaaacaaaaaaggaaactgttaagtagtcgtttaaaaaaaaaatcccagtagcgcagtagctttagaacgttaggaagactgtacactttgttgaattacactcacaattagaaactagagagaggcagacacgttccctatttccaggagacagattgcgcttgatgcgccttttttttctgttggtggataaggtggttctggagggcaggcagccttgtgtcggggagtatcctcaagcgacacttggtcatctgacaaggacttgggctgctcccacggctcccagcagcggtaggaaccccatctcggctgtcaatggagagaattttatgataaaagattcacgcaccagaagggtgtctgtgagaacaaggcttctagtgaactagacagtttgtaccatgagggaatttctagtagtgaaggaaaatggcttggaaaagccaatctgtgatcaaaatgtgaaaacctcctgaagcagaagtgcctatgttttatttctcagcaccatgtgagagctcctttgattggaacattttttgaggtttctgtctgttcttcgtgtcatcccattattcggtcagcatataccactggatctataaaacaactaaaggtaatttttagtcttagccaagaaaagctaaccaaacaagctgcaaaaaacacagatccccaaactttctttattaaagagatttggaatatttttgtcaatgtatgacttttcagccacaattacatgtcatcattttaggatggcaccaatacttgggacacgatgatttaggcaccccaccaggtaagcaaactcagcattaaggatgtagttataaaattagcgcataatggtaggtaatgcagtttgaaaccatttcactcaggtaaaatgcaacctgaccacattatttaaaaatcagcagaattttctaataactactctgagtgcaacaacaagtgaaaaaggagctcaaagagtgctcattaagagtaacaataatttctagggaccttgactttgcatttgaggaaaatcttgtgtaactttattccattatgctcctaatatgctttctaatcccaaattaaaactctaatacaaattcattttgtagaagtcttaaaatcagtcctctttctttttgaaaacattattttagtatttattttaattaattggtttcttaaaaaatcatacactagtcattgacatatgtaatacttcctttaccagagaagactcaaccaatgctgccttaagatttaatgttattccctttttagtcactgtgcatttataagtttgtttactagttgacctttcctgaatagagattagtttcggcatttctccatctgtatataaataacaggtaatatttaatcatcagtgtatgacttgatatcacataacgttctggtgtggtttcctgtagtgatcttagggttttgatttaaaagaaatacacaaaacattaggtacaatttcctttagtttgctaaacacccaaaggatattttgttttgttggttctgcacttaaactgaaatacaacctatgtgaactattgggcaaagcctgcagcctaattaattaaaacctccatttttatttgaatagattcaagtagaaattgccgttaggaatcactgggatcttttcggattttgaccttttcaaaggtagcaataactactccagaggttgtaatctttctgttggtagtggcttttcatcagctaaataatcatctctgcctcaaatgtgttgcctgtcacctagttgatgttccataaaatccctgggttctgaagtgaattattataattaataatcaggagggcgaatcttcagtggcatctgatggaatgaaagaactgtgtctgagcagcctaaaagctgtttgtgacatgccaccttgggaaacaagagtgaggaagaaaacacagtcatcaagtgccagcgtgtgccacccattgtactaggtactttattatgcatttatgtatatgtgtgtgtgtctgtgtatacacacaaacacatatacataagtgtttacacacacacacgcacaatatgtggttaagcctggtaagcctgctaaaatggcaaagcggcctggcgcgtggctcacgcctataatcccagcactttgggaggccaaggtgggcagatcacttgaggtcaggagttcaagatcaggaccaacatggtgaaaccccatctctactaaaaatacaaaaattagccgggcgtggtggcaggtgcctgtaatcccagctacttgagagtctgaagcaggagaattgcttgaacctgggaggcggaggttgcagtgagccgagaccatgccactgcactccagcctgggcaacaaagctagactccatctcaaaaaaaataaaaaataaaatggcgaagcacctgtccatgtgtttggccaaagccgtcctccgaggtcttaagggggccagagtagcagtcctcgttggcgttctaaggcagttgttctggcttccagtcagctctaaaccttaccttctggggactccaggattttctgctcttggcctaatgcaagagaaaggagaatccccagagaaagaagtggggaggtaaagagcgttttctccacttacctttgggttttttatgctcccaagtagaaataaatatcaagaattcacaggttgactgaagcacaagttgcccctgggctctgtgtcaaggctggtggtactgtaggtgttatgagaggacccatagggtgtccttcaggtgagctgttgtccacagcacctttcatatctgctgtaaagggagccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctacctccaacacagccaagctctgatacctcagatataagcaaaaacaagtgaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattcaagcttattaaaagcatcaagcattatatgccacactcagcattttcatagacatagtcattaggagaatctggacaaagtaatactcttgtagaaacggaagcatcttgctgtacttgaaagataactggactcagagctacttcactcctcacttgggcaaatgccgatatcactttgcttagctataaagtgccatcagtgggatggatcgtcttcacggtgaaccgtgttacacttctgcaattcctcaagttcatattaattaggaagtggcagagctaggacacaaaattcctaattcctgaagatagttagtctcctaattaagtgcttctcactatattgggatgccttctttaggaataagactttcctttaattttcaagttccacaacttctaaaattattttgctatctcgaagcagcagaatattgatcatttttctcagtttaggctaacacagtccacaccattaccacttaaataaagtaaccgaatgctaaatattatccttatcaaacatccatcactttgttgcttttatgagatgtagattgctaaaaacttttgagctagtagacgttacctttaagcatcaatgaatgcaaacagtgaagacctcaaagaagagttacctcattttctctacatgatctccaatgtagtctcagataaggcccatacatagttaaaagctggtaacagctctgaacagaagtatgtattaaatgtttcaaacttgtatatatttttgaatgcttttgtttttggagtgaatttttaatactctgtgttaaaagaaaaacattccatcttgtaggcagtgttcctcagtaaaaatctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgactaagactgtgttacgtgctttctcacagctgccatatattctcatgtaatctttacaaccgctctacaaggtatgtctaattatttccattttacttattgagaatctaggctcagaggagttaaaattctgaaaatctcaccgataagttggagaatttaagtttgtaagttggagaatgcaggttttctgactccaaatctagtgctcagtccatgagacaaaactgcctcctggaggccatggaagtccattaactttaagaaagttaaacacagttttggtttgtttggcaaatatttcatctctcaagccatactgtgtcacccctccatgtattctcttactaaatgattgctcacttgggaacttaatcgatcctggaaagcctggcggttccccagtattttctgcctactgggaaccttctgtctttatccaataagtaatttatattacctgtcatctaccttaaagggcagatggtcatgtgaatttattctaatgaaagttagtttacaagctgcacctgttttgacattggactcactgcttaaaaagtaaaggagttcctaacttacgcaacaattacatgctcaggttttttacttttgccatttaattttggtcagaggatttttataatctgtaggctatagcactgtcatagaaaaatatacctttttttttttttgagactcaggagtctcactctgttgcccaggctggagtgcagtggtgcaatctctgcctcctgggttcaagccatcctcctgcctcagtctcccaagtagctgggattacaagcgtgtgccaccacgctcggctaatttttgtatttttagtggagatggggtttcatcatgttggccaggctggtctcgaactccgacctcagtgatccacctgcctcggcctcccaaagtggaaaaatatacttatttactcgttttctgttcttttttcctttatcggggcatatttattttctctttggagacttacaaagcaataggttatatgaaactctgagatcatctagtcaaattcccccattttatcaataaggaaatttaaggccagagatattaaagggcccatccaagatcagccaaacaataagtaatagattcaggactagagagttagtccagaactctctcctccatatcacagctgagaagatttagatttttttaaattaatagagctgcatctggcaaaatgacatccggctcacagaagaccctagtgagcttcttgtaccttcccagaaaaacccagaagaaggccaaatctcaattctagaatctagaaggaattgatgtaatttatgaggcatatggaggtagcttggggcaaaagtttccaagtagctcaattcctggcttacttcatgaaacaggccctgtgaaattaaaaacatgaaagctatttagtacttgtcctcttccccaatcatgcctgtcaccttactcggagtcagagctcctgagccagagaaatactagctgatgcttattacaccgggaagagaaaaagttcatatccaccctctcttctttctccccaacccacttcctcttcattcaatcccacataaatcttagagctaaaacaggagcagaaagcagagaaggactattagacctatggtggcatcccaagaataaagccctttaggtgaaggtagaaacaataaatacctgagtagcagaacacgcaaatattatgattttttatgtatgatgttgggttcagagacccataaaatcaggcaataggaaggaaaaggatgctgcttcaatagaaaagtaaactagaaattggacttggaaatatgttcatcaccttaccattgacctgggatttaactgaaaaagggattcaacaaacattcacatgaacagggtctgggaagaaaggaccacgtttaaggatgagtatagagaaaaaaataaaatgaggcatataaaaaagtcaatgggccaggcgcggtggctcacgcctataatccaagcactttgggatgccgaggcaggcagatcatctgaggtcaggagttcaagaccagcctggccaacatggtgaaccccgtctctactaaaaatacaaatattagccgggcatggtagcacatgcctgtaattccagctactcgggaggctgaggcgggagaatcgcttgaacccaggaggcggaggtttcagtgagccgagattgcaccactgcactccagcctgggcaacagagtgagactccatctcaaaaaaacagaaaaaaaagtaacaaattgcctgtaagaaaaccaaagagcatctggcttcagacttctgctctatagcaccaaatgccaggaaacaatagagaattgtgagggggaaaagttgtgactttggaattttatacatattttatatgttaagatacataattttttagttatgataaccatccaggaaatatatgagctatgtaatagtcttacaaagataataagttgtacagcaacctacgaggcttgatttaaataaaacaatgtttgcttagtatcctaatttcagtgggctctgggctattaaataccaggacattatccactagaggaagggtatgtatgcttttaaatagataatatggctagaagctacatatctaaaagcacccgaagtcctcatatgaataggctaaattaatacaataaggtgtaataaatgccataccacagcatcatgtttcttcatttttattaccgaaataatgtataaattgctcttgattttccccaccatcatttaaaacactctatcctgaaagagtccactgcttccaagtgagaaaagccaaggagtcccctgcgttgggggtgtaataacctagactagagcttatagactgaagcccatgtgcttctccatgctcaaacgcagaactaaaaatgggtataaagtcagaaaattgcagaatataagtctgtgtttcaaaaagcaatcaggaaaaaacaaacaaaaaacttgttttagaatacaaatgcaagaaaagttcaatttcaacagcagaaagatggcctggggcagtgagatgctttccttagctgtacttgaagttttatggaacgccatttaaattcagacatcaagggaatgaatgcagttttaaaaatccgaattatttctggagtctacaatgtcagtgttagaactaatgctgggttgttttgttttttcatttgcttgcactggaaggccttgaaaacacacaggagtgtagagtatcgtcagctctgatgctcagtttcttcctggcaatagaatggttttatctgtgccccaagcttttgccaatttaaactctaaactaaattttcaatgacaccagcatgtttgctttaaatttagcaatagaataggcaatggactgctttgcatttccttagtttttcattctgaaacagagcaaaacatcttcccaaagagatggagacaatctcttctgggtagattccaagtataacctgtcccagggtcctcttgctcagctgtgactaacaaaagtctgttcaatttaactacttagataagaagcgcaatgcttttatttaaaaatttaatattttctatggggctgtattttccaaataatagcaacaaaactgtcctaacgttttcactgttctgtaattttgttttaatatagaggatacccataatttcttaacactggaaacatcattctgaacgatgtaggaagcggtcagtaacgtgaatgatgttattgtaccgtctccagctttttccttcttcccccagatggtcgcacctgtgcatacatccctgtgcatgtgggggcacatgagtgggaaagtgggtgtcactcctattttctgtcctagagtgtcagcgttggaagggatttttttttgttcctccagtccggccctctagttgatagtccagtagtctgttaacaatttgtaaggacctgggttatattttaaaggtggttgttgttgttgtttgggttcacttatgtatatgcagcttgactgttcaacccagatttttaaacaataaaaagatttaatgtata

SEQ ID NO: 146051 - DNA, 2643 bp, Homo sapiens
  Payload ID: 8962
  Gene Symbol: KIAA1958
  Gene Name: KIAA1958
  Uniprot ID: Q8N8K9
  ENST ID: ENST00000374244
  CDS Start-End: 129-2345
cctcgcgccccttcggcccgtcccgtccagcccgggctgcccggctctcgcaggcccccccgcgccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagaccaggatgaaagagcagctgagctcagcagggagcagaacgagaaaaccatccggagcacgcagaccgcgctccgcaatttccgtgagttcctcatctccaagtatccttctgaaacaagagagatttatgtcatcccttgcaaggagttggatgcctaccttgcctctttctttgttgatgccaggcagaaggatgggtccgaatacgaacccaacagcttggccaattaccagtgtgggctcgaaaggtacctgaaagaacacaggtatggctatagcatcaccagggataaggaattcaagcgttcccaagaggccctgaagcagaagcaaattgaactccgctgtaaaggaaaaggaaataagccacacaagtccatgaagctcacctttgctgacgagctcatcctgcggaaaaggggactgctaagccgatataaccccgagggtttgctcaacctagtctggctcaacaacacaaaagcttttgggcattgcacaggcttccatggatctaccttaaaatggggtgatatccggctccgggtaacagagacgggtctcgagtacttggagtggatgggtcaggacactggagacttgaatgccaaaaccaagagaggggggacagactcccgtgtgtatgccacccagcacgccccacagacctgccctgtccaggactataaggagtatgcccagcggcggcctcccgccatgcgctacgaggatgcccctttctacttatccatcaagccagtcgtgaacctggcggctctgcattggtacaactgccaggcccttggcaagaacaagctggccaagatggtgaagaccatgtgtgagaagggcaacatccctggcaggaaaaccaacttcagtgtgtatcagagctgcagcaccttgtctgaggcccagagcaaccagctcgtgctgatctgtaacaatctgagccagcaggctgcccagtcagtggccggccactccaacaatggcaatttcatcgtctccgcctcctatgactcttcctcagacaccgcttgaccaggtggcttgagcaagactccagtttggttactgtgtccggagaaactgtgattatacaccgcttctcgttccccttcctgtgccctcagtgttaattcactttataaaaatataaatatataatatatttttctttttacaaataagccaatggagataatttagtattactaacatagtatttataggcttaagacaaatgtacttgtgggcgatcaaatgtaattactgttacagactttacaaaaccatacgtggttctcaggcaacacaaagtagagagggaattctgttt

SEQ ID NO: 146052 - DNA, 7650 bp, Homo sapiens
  Payload ID: 8962
  Gene Symbol: KIAA1958
  Gene Name: KIAA1958
  Uniprot ID: Q8N8K9
  ENST ID: ENST00000536272
  CDS Start-End: 176-2410
gctccacttacctttggtgcccggccctctggccgctctcctcccgccctcgcgccccttcggcccgtcccgtccagcccgggctgcccggctctcgcaggcccccccgcgccgaccgcgttcctatggacagacgcacagacacctgcaggagtgacactgctgatcctgtaacatggaggattgtcttcatacctcatctgagaatctgtccaaattggtcagctgggcccatagccatgggactatttgcagcctcattccaaacctgaaacacttgctttctgaaggttcccatgggaacctgacagcaatgtggggctgtagtgctggccatgcttatcactggccactaacagctacttgcagagctgggtcccaagagagggtctgtttccaggataacagaagttttaactctgatagtcccagtataatcggggtgccctctgagacacagactagccctgttgaaaggtaccctgggagaccagtgaaagcaaagctagactgtaaccggaccagagactcttgtgacttctcctactgtagtgagccctctgaactggatgaaactgttgaagaatatgaagatgagaacaccctgtttgacatggtttgtgagtcttctgttacagatgaggatagtgactttgaaccccaaacccaaaggcctcaaagcattgctcgcaaaagacctggggtagtcccatcttccctccattcaagctcccagacgcagatggttgacgaatgcagcaatgatgtcatcatcaagaaaatcaaacaagaaatccccgaagattattacattgtggcaaatgcagaactgacaggaggagtagatggaccagccctgtccttgacacagatggcaaaacccaagcctcagactcacgctggtccctcctgtgtagggtctgctaaactgattccccatgtcacatctgccatcagcacggagctagacccacacggtatgtctgcatccccctctgtgatctccagaccaattgtccagaagactgctagggtatctctggcttcaccaaacagaggaccccctggtacacatggcaccaaccaacaggtggccatgcaaatgcctgtgagcacatcccatcctaacaaacagatcagtatccccttgtctgccctgcagctgcctggacaggatgagcaagttgcctctgaagagttcctgtcccatctgcccagccaggtctcctcctgtgaggtagccctttctccctcagttaacacagagccagaagtgagctccagtcagcagcagcccccagtcgctccagccataaccactgaggccacagcacagtgcataccagaccaggatgaaagagcagctgagctcagcagggagcagaacgagaaaaccatccggagcacgcagaccgcgctccgcaatttcccttattccactaagctcaacaaatttcctgtatttaatattaatgatgacttgaatgatctgtgtaccagtgcagtaagcccaaatactaccaaagccacgcggtacgccttgaatgtgtggcgttattggtgcatgaccaacgggctcaaagaccacacagacatcaccaagatccctgcagtgaagttgaacgagctgctcgagaacttttatgtcaccgtcaagaagagcgacggctcggacttcctggccacctcgctccatgctattcgccgaggcctggaccgcatcctgaagaatgcaggtgtcggcttttccatcaccagcagcaccttcagctcctccaccaagaaactcaaggagaagctgtgggtgctgagtaaggcaggcatgtcgggcgcgcgttctcgcaacatcgtctacttctccctttctgacgaggaggagatgtggcaggcagggtgtctgggggatgacagccctatcactctcctgtccactgtggtcaagtacaacagccagtacctgaacatgcggacgctgcaggagcatgcggatctgatgtatggtgacatcgagctgctcaaagacccccaaaaccagccctactttgcccggacggacagcgtcaagcgggagagtcggagcggctccaccagagtgtgtcacgggaagatctaccatgagcattcccggggacacaaacagtgcccttactgcctcctctacaagtacatgtacatccaccggccgcccacccaaatggaggccaagtcccccttctacctgactgccaggaaggaggccacagacatgggcagcgtgtggtatgaggagcagaggatggggctgcgctctcttcggggaattgtcccaaacttagccaagaaggtcaagctggaaaactgtgagaacttcacctttgtctcgttcactcaggtctcccggaggcttggctcccacagctgctgccagtgagcccccactggggcccggccactgccctgtcacctgctcgggccagccagggttggagcagctggagctccttggaggcaggggctgaccaggtgtgacctcccggtctggcggctctcccctggtgtggcctgccctccctttgacttggggtttgctttttaaaatgaaactagatgagtctaaatcattcggatggtttatccaaatgtgcgtcaacttcgttagcttttagaatctaacacaatgtataattgttacatacaagagtgaggaaattcattttctctagtgcctttctagcacaggttttctcaaaacaaacaaacaaaaaaggaaactgttaagtagtcgtttaaaaaaaaaatcccagtagcgcagtagctttagaacgttaggaagactgtacactttgttgaattacactcacaattagaaactagagagaggcagacacgttccctatttccaggagacagattgcgcttgatgcgccttttttttctgttggtggataaggtggttctggagggcaggcagccttgtgtcggggagtatcctcaagcgacacttggtcatctgacaaggacttgggctgctcccacggctcccagcagcggtaggaaccccatctcggctgtcaatggagagaattttatgataaaagattcacgcaccagaagggtgtctgtgagaacaaggcttctagtgaactagacagtttgtaccatgagggaatttctagtagtgaaggaaaatggcttggaaaagccaatctgtgatcaaaatgtgaaaacctcctgaagcagaagtgcctatgttttatttctcagcaccatgtgagagctcctttgattggaacattttttgaggtttctgtctgttcttcgtgtcatcccattattcggtcagcatataccactggatctataaaacaactaaaggtaatttttagtcttagccaagaaaagctaaccaaacaagctgcaaaaaacacagatccccaaactttctttattaaagagatttggaatatttttgtcaatgtatgacttttcagccacaattacatgtcatcattttaggatggcaccaatacttgggacacgatgatttaggcaccccaccaggtaagcaaactcagcattaaggatgtagttataaaattagcgcataatggtaggtaatgcagtttgaaaccatttcactcaggtaaaatgcaacctgaccacattatttaaaaatcagcagaattttctaataactactctgagtgcaacaacaagtgaaaaaggagctcaaagagtgctcattaagagtaacaataatttctagggaccttgactttgcatttgaggaaaatcttgtgtaactttattccattatgctcctaatatgctttctaatcccaaattaaaactctaatacaaattcattttgtagaagtcttaaaatcagtcctctttctttttgaaaacattattttagtatttattttaattaattggtttcttaaaaaatcatacactagtcattgacatatgtaatacttcctttaccagagaagactcaaccaatgctgccttaagatttaatgttattccctttttagtcactgtgcatttataagtttgtttactagttgacctttcctgaatagagattagtttcggcatttctccatctgtatataaataacaggtaatatttaatcatcagtgtatgacttgatatcacataacgttctggtgtggtttcctgtagtgatcttagggttttgatttaaaagaaatacacaaaacattaggtacaatttcctttagtttgctaaacacccaaaggatattttgttttgttggttctgcacttaaactgaaatacaacctatgtgaactattgggcaaagcctgcagcctaattaattaaaacctccatttttatttgaatagattcaagtagaaattgccgttaggaatcactgggatcttttcggattttgaccttttcaaaggtagcaataactactccagaggttgtaatctttctgttggtagtggcttttcatcagctaaataatcatctctgcctcaaatgtgttgcctgtcacctagttgatgttccataaaatccctgggttctgaagtgaattattataattaataatcaggagggcgaatcttcagtggcatctgatggaatgaaagaactgtgtctgagcagcctaaaagctgtttgtgacatgccaccttgggaaacaagagtgaggaagaaaacacagtcatcaagtgccagcgtgtgccacccattgtactaggtactttattatgcatttatgtatatgtgtgtgtgtctgtgtatacacacaaacacatatacataagtgtttacacacacacacgcacaatatgtggttaagcctggtaagcctgctaaaatggcaaagcggcctggcgcgtggctcacgcctataatcccagcactttgggaggccaaggtgggcagatcacttgaggtcaggagttcaagatcaggaccaacatggtgaaaccccatctctactaaaaatacaaaaattagccgggcgtggtggcaggtgcctgtaatcccagctacttgagagtctgaagcaggagaattgcttgaacctgggaggcggaggttgcagtgagccgagaccatgccactgcactccagcctgggcaacaaagctagactccatctcaaaaaaaataaaaaataaaatggcgaagcacctgtccatgtgtttggccaaagccgtcctccgaggtcttaagggggccagagtagcagtcctcgttggcgttctaaggcagttgttctggcttccagtcagctctaaaccttaccttctggggactccaggattttctgctcttggcctaatgcaagagaaaggagaatccccagagaaagaagtggggaggtaaagagcgttttctccacttacctttgggttttttatgctcccaagtagaaataaatatcaagaattcacaggttgactgaagcacaagttgcccctgggctctgtgtcaaggctggtggtactgtaggtgttatgagaggacccatagggtgtccttcaggtgagctgttgtccacagcacctttcatatctgctgtaaagggagccctactttctgtctatcccccccaccgccggcccccggaatctaagcagactccctgttggaagcttactctggcacagaagctaggatgtcaccttaaagggtgtgattcaattgaatatagtttagtgcggtaccaggcacatcataagcatgcaataaatgttagccagcttagttataacttttggtaataattaatattatttaactaatttgcattataccacttatttcttccattatggagattctgtctcccttaaactgttaaacttgaagaagaaaccaaacatgataatctggtcaagttaacacattttcgcccatgaattctacctccaacacagccaagctctgatacctcagatataagcaaaaacaagtgaaggaagaacagaaaagccttatggggctttatgagaaggtttttccattgtttagtgtgtttgcaaaaaggaattttatggaagtacctaaccaaagctgtgacagaagggtctccttggtcatgtggcattttccagctttccttggattttatgctacattaatttgccctggctgataaatggtgtttgaagaaatgtgaaattttgttactttgatttttattttaattcaagcttattaaaagcatcaagcattatatgccacactcagcattttcatagacatagtcattaggagaatctggacaaagtaatactcttgtagaaacggaagcatcttgctgtacttgaaagataactggactcagagctacttcactcctcacttgggcaaatgccgatatcactttgcttagctataaagtgccatcagtgggatggatcgtcttcacggtgaaccgtgttacacttctgcaattcctcaagttcatattaattaggaagtggcagagctaggacacaaaattcctaattcctgaagatagttagtctcctaattaagtgcttctcactatattgggatgccttctttaggaataagactttcctttaattttcaagttccacaacttctaaaattattttgctatctcgaagcagcagaatattgatcatttttctcagtttaggctaacacagtccacaccattaccacttaaataaagtaaccgaatgctaaatattatccttatcaaacatccatcactttgttgcttttatgagatgtagattgctaaaaacttttgagctagtagacgttacctttaagcatcaatgaatgcaaacagtgaagacctcaaagaagagttacctcattttctctacatgatctccaatgtagtctcagataaggcccatacatagttaaaagctggtaacagctctgaacagaagtatgtattaaatgtttcaaacttgtatatatttttgaatgcttttgtttttggagtgaatttttaatactctgtgttaaaagaaaaacattccatcttgtaggcagtgttcctcagtaaaaatctttgttgcattttcccatataaatgaatcacccttattaaaacaggaggagggagggatttgtggtgacctaccgctgccctccctttctaagagaagaggaggccatggggtatgataactaaatgaacatctctggaagttcctccgtctgatatgtgtattctgacataacagaatttcccaagacttctttgaggaaggctgtccacgcttcaggcaaagtttacccattattattatgattttgaatattccttgttcattacagtccagaaaatctgcagaagttctccatgttcagtggttgaccagaatctgattgttgcgctcaattaaagtgcttattatttagctaaaacaacttatatggaagttaattatttcaggaaatacataataagaccaaaaaaatcactggataatatgtagatatattttagttccattactattaatagcaattagataactctccctccccccattgaggtgagaatgggctcctagatacttggtggtcaatagaactgatttgattaactttcatttaactgtggttattgttacatctactgattttttcaaataaaaatttctagaaggctcagatttgact

SEQ ID NO: 146053 - DNA, 1925 bp, Homo sapiens
  Payload ID: 8963
  Gene Symbol: KIAA2012
  Gene Name: KIAA2012
  ENST ID: ENST00000498697
  CDS Start-End: 1-1925
gtgaagaagaaaaaggcaccaaaggctttgaaattacctcctatctcagaagaaccacccagagtcttggagcccctgaagagccaatttaaagccaatgagcccccaacagagctcttcatcttaccggtggagattcattaccacaccaaacaacccccaaaagagaaagcccacagaagaggtgctccacaccctgagtcagaaccagaaagcagcgaagaatccacacctgtgtggagacctcccctgaagcatgcgtccttagaaacaccatgggagttaacagtgcatctcccagtggacgcgagcagggacacactctcacctcaagatgatgatgccccacctcacgatgtggccccaccattggatcttctacccccgattaaaggaaaaaaaagtcctgagagccagaagggcgtggacagccctaggacatcagaccacaacagccccccaagtctcccgaacatgagagtgcccaggagggcactgccagcagctcaagcctatgaatctgtcaattcaaatatcagccatgaagaggaagggcctagtagtcagcatttcctaaaagcaaacactgaacctagagccaatcttcacatgaacctttatgaaacctcaccgttgacccaaacaacagagaagcagggagcccagcagtccttggaggcagcagctcagaagacaggagagcctcaaagttgtataaataaagcgctgatatgttcaaacagaaaagaattttacacgcgcaagctgcacatcgacatgacgccgttcctgaaggaaagtggaaatgcactggactatcaggaagaagcagggagacccctcagagaaactcaccacaacgaccaagacccagagccaaggagtatgacccttgactctcccagggcttcccggactgagcacatccagaccccagaagcagatattgtgcaaaaagtgggcagagattatgatgtacaccacctacacagaggacttctgggatacgggcctgagtcacccgagaggttgagtgctgtgtatacatctcttcttccaagagaaagagaagggaaggctgaaccaagactgtttagccaggagacatcagccaacatcagtcatgagagggatttgattaacgaggccaagagaaaggaaaaacccaagaaagacaaaaccaaaggacccaaaagcgagagagaaggaaaggtctacgggcaagcagaggctgccattggaaagtcaaaggactcaaaggctaaaaaaaaattagaaaaaaaaacaagaccccaaaggaaaaggacacagaaggaaagaaatctggagatagcggcagagctgagcgggcctgatgtcagctatgaggaaacagaagacacctcaaatagaggttcctttgcctcagactcctttgtagaggacccttggctttctcccaaatatgatgcccaggaaagccaagtttctctagatggaagatcatcaccctctcagattgcaactgtcactggcaacatggaatctaaagaagagagaagatgtgaggacccttccaaggccctcctcactaagagggagcaggagaaggcttcctgggacaggcttcgagcagaaagagccgagatgaggtggctggaggtggagaagaagagaagggagcaggaagagcaaaggcagctccagcaggagcagctggagagagcaaaaaagatggaggaggagctggagctggagcagcagagacgtacagaagagatccgcttgaggaaacagagactccaagaagaacagcagcggcaggaggaggaggagagaaagcagcagctccggttgaaagcagcccaggagagagcccggcaacagcaagaggagtttcggaggaaactgcgagaactacagagaaaaaagcagcaggaggaagc

SEQ ID NO: 146054 - DNA, 4029 bp, Homo sapiens
  Payload ID: 8963
  Gene Symbol: KIAA2012
  Gene Name: KIAA2012
  Uniprot ID: Q0VF49
  ENST ID: ENST00000541917
  CDS Start-End: 374-3916
agacaagaaggatggtgctgtggccgagatctgtagatgcacacggctggtaacagagcaaccgggaccaagggacaacaagagctcaggagaaggggagagacaggtcgcccagagagtagacaatccagggcttgaggaggctggctgtgcggtttattttttctctccacaaagacacacactgtctaaactgtgtggctggttgttactaagaagctgctgcgagagggaaaaatgtatttaataaaaggccctgtgtttgtggtcttcttgggcttgctgtgagctctggaaatcttgaggtgtgaccagatttcagccttcaaaaccaagatggactgcccttgagaaggggtggtcagagggaaacatgttcacgctctccctcctgagccggggccacgggaagctgggccaggacaaacagaagttagaagtctactttgaaccagaggattacttgaactggaggtccccagaagactatgttcctgtcagcaaacctcaagataagaacaatgccagtcagcactcctggagcctctttctccctaaaactttcagtactagaaagggtgccctgatcctgtactcagaaggttttgccatttcggcatggacacccaaagagaggagaaaaggcccctactgccccagaggtccctggaggaagctggatcttgaactgcacacacttcaagacctcaaagaagccatcctggcatatggaaggcagcagggagagcaggacagagcctggcaaccatacctccacttccgaagccagctggagagccaggcccaacggcagatccagccagggcattcagccaagagatacctccgaggcctcctgcggacttggcccccagacgccatgtataggctctggtgcgcaggatacatcaaggattctgtgctactccaggacagtcaacttaatgtaccaaagaagctcaggccacaacaagatctttcaggtgtacccccaaaataccatctcctgcctgtcttcccttcattttggattcaacaaggaaaatcttttgaacaacgtcaacagggcctggatgaaggggaagctggagctgctggacacgtggaccagggccctctagccaagaaccatggcagtcaggggactcgcttgccaccacgcaggaagcagccctggcaggaagatgaaacgcaggcagaggacacgtcaatagagaatcacctttgtttatatgcttcaaaggagagctacaatgaaaagacacagcaaacctccaggaaggcctttgggcatggccgcatcgatcactcttggctcccaagtgacaaatcccacattacattctgtggaggcgccttccctaataggaaggcagatctcagcgataaacaaaggaacgtgaaactccacaaggccagaagcagccacttgttacaggtgcttcctgctgaaagaagcctcttccctcctgtagcatctgccactggctccagaataatcacccctggggaagtgaagaagaaaaaggcaccaaaggctttgaaattacctcctatctcagaagaaccacccagagtcttggagcccctgaagagccaatttaaagccaatgagcccccaacagagctcttcatcttaccggtggagattcattaccacaccaaacaacccccaaaagagaaagcccacagaagaggtgctccacaccctgagtcagaaccagaaagcagcgaagaatccacacctgtgtggagacctcccctgaagcatgcgtccttagaaacaccatgggagttaacagtgcatctcccagtggacgcgagcagggacacactctcacctcaaggtagctcctccctccctccagcatccctcgggaacctcactctgaagggaagcaaggcaagacacacaagggtccacagccaaggaaaaggagtctggaagggagatgatgatgccccacctcacgatgtggccccaccattggatcttctacccccgattaaaggaaaaaaaagtcctgagagccagaagggcgtggacagccctaggacatcagaccacaacagccccccaagtctcccgaacatgagagtgcccaggagggcactgccagcagctcaagaagattccagcgaccctacactgggacacttcttgctgggtccagatggagaaaaagtctgcctgtccctcccagggcatacccaaaccgaggcgcttccatcgggtaaagcctatgaatctgtcaattcaaatatcagccatgaagaggaagggcctagtagtcagcatttcctaaaagcaaacactgaacctagagccaatcttcacatgaacctttatgaaacctcaccgttgacccaaacaacagagaagcagggagcccagcagtccttggaggcagcagctcagaagacaggagagcctcaaagttgtataaataaagcgctgatatgttcaaacagaaaagaattttacacgcgcaagctgcacatcgacatgacgccgttcctgaaggaaagtggaaatgcactggactatcaggaagaagcagggagacccctcagagaaactcaccacaacgaccaagacccagagccaaggagtatgacccttgactctcccagggcttcccggactgagcacatccagaccccagaagcagatattgtgcaaaaagtgggcagagattatgatgtacaccacctacacagaggacttctgggatacgggcctgagtcacccgagaggttgagtgctgtgtatacatctcttcttccaagagaaagagaagggaaggctgaaccaagactgtttagccaggagacatcagccaacatcagtcatgagagggatttgattaacgaggccaagagaaaggaaaaacccaagaaagacaaaaccaaaggacccaaaagcgagagagaaggaaaggtctacgggcaagcagaggctgccattggaaagtcaaaggactcaaaggctaaaaaaaaattagaaaaaaaaacaagaccccaaaggaaaaggacacagaaggaaagaaatctggagatagcggcagagctgagcgggcctgatgtcagctatgaggaaacagaagacacctcaaatagaggttcctttgcctcagactcctttgtagaggacccttggctttctcccaaatatgatgcccaggaaagccaagtttctctagatggaagatcatcaccctctcagattgcaactgtcactggcaacatggaatctaaagaagagagaagatgtgaggacccttccaaggccctcctcactaagagggagcaggagaaggcttcctgggacaggcttcgagcagaaagagccgagatgaggtggctggaggtggagaagaagagaagggagcaggaagagcaaaggcagctccagcaggagcagctggagagagcaaaaaagatggaggaggagctggagctggagcagcagagacgtacagaagagatccgcttgaggaaacagagactccaagaagaacagcagcggcaggaggaggaggagagaaagcagcagctccggttgaaagcagcccaggagagagcccggcaacagcaagaggagtttcggaggaaactgcgagaactacagagaaaaaagcagcaggaggaagccgagagggccgaggcagagaagcaaaggcaagaggaattggaaatgcagttagaagaagaacaaaaacacctgatggaaatggctgaagaggaacgactggagtaccagcggcggaaacaggaagcagaagagaaggctcggctggaggcagaggagaggaggcaaaaagaagaggaagcagcaagactggctctggaagaagccacgaaacaagcccaggaacaagccaggtactggatatttgggcaacagttgccatagggggatggttcaagggcttcactgtccagtgctagtgctagctttgcactgcctttagacaagaaaagtccccccacccccagcatggcttggaagactgaaaggcatagagg

SEQ ID NO: 146055 - DNA, 2815 bp, Homo sapiens
  Payload ID: 8964
  Gene Symbol: KIAA2013
  Gene Name: KIAA2013
  Uniprot ID: Q8IYS2
  ENST ID: ENST00000376572
  CDS Start-End: 187-2091
tttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaatacttgaaatggaactcactccttccactttccccctttcttctgtcccaggaaatagatcatcttttgaaaagactcttgtctaggaaaagttgtgtccttttcctaatttaacgtgttctttcttaatgaagttttaatttatttttgttgagattttgctagatggcttttgcatcccctgtagatggtgagtgttggcggtgatgtccatctcggcgttcggaggccccacggtcccgaggctgggccggggccccccagggtggctgtgctgctgcctgtaggagggtgcgggttgtgctgtcatcctcgggtttgcacgcccttttttaggagcctgtggacatctgtggttttgtactttggggcttcaggggaggtgtttaactttctagtgattgatgattgtcaggttttgaaataccaaagcttttttgttctgtttttaaataaatatctttcaaactttca

SEQ ID NO: 146056 - DNA, 2539 bp, Homo sapiens
  Payload ID: 8964
  Gene Symbol: KIAA2013
  Gene Name: KIAA2013
  Uniprot ID: Q8IYS2
  ENST ID: ENST00000376576
  CDS Start-End: 192-2195
cgtcgtttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggtaggaagccgccatctggtcgaaacccgaggccttggccttgctctcagccctgtgtctcggaaggggctagcctggcgagggggggtgaggcctgggcaggaatgggtgtcctgatgccctcagcccttgacaccagagagcgcgcacaagtgttttgagaggagacgacgaggaagggaaagctggaaatccaggtgtgaattgatggtcttctggctttccagggcagccctcccctcctcccgcatcataaatctcagcatttaaaaataactgcaagctgggtgtggtggcttgtgcctgtagtcccagctacttgggaggctgagatgggagaatcccttgagcccaggagtttgaggctgcagtgaactatgattgtgtcattgcactctagctggggcaacagagcaagaccctgtctcaaaaaagcaaaaaacaaaaaagcaaataaaagt

SEQ ID NO: 146057 - DNA, 2170 bp, Homo sapiens
  Payload ID: 8964
  Gene Symbol: KIAA2013
  Gene Name: KIAA2013
  Uniprot ID: Q8IYS2
  ENST ID: ENST00000616327
  CDS Start-End: 134-2038
gagaagaaggaggaagcaggggtggcggctgctgcggcggttgcggcgggggccggggtgggcgccgcggtccgggccgggcagtgaggcgcgggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcag

SEQ ID NO: 146058 - DNA, 11719 bp, Homo sapiens
  Payload ID: 8965
  Gene Symbol: KIAA2022
  Gene Name: KIAA2022
  Uniprot ID: Q5QGS0
  ENST ID: ENST00000055682
  CDS Start-End: 613-5163
cagtagcatcagcagcagcagcagcagccgccgccgccaccaccgccgccacagcagtagcattagcggcagtagcagcatttagcaatagctttaacagctatagcgacagtagcagccgccctcctctctccctctcgcggacggccgcagccaccgcacagagcgggctccaggcgccgagcgcgcagcccgctcgctaggtagctccagccggggcgagcgacagtgtaagcgaagcacggacccttggagcagccgggcagccgcggaggctctgagtttcagggccagagcccgacagctctgactccatctagcgcggcggcggcggagcctgagggagcgagcgaggagagaggcgcgtccacctggcgggcccagcgtatggagctgaggcagaggcggcggcggcggcggcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggttggacagcatttggacttggaatgaaacaataagaggttatattcatggataaccaacaagataaggctattgttgcctcagccaacggagaaaacactctgattaatggggtcaaagaaaatgactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagtttaaaatactgctttagaatcatatgtattagaaatcaaaccatttctaattaaatctatgtcccaaataaaacgttctttatcatctagagcagtgtttctcaaactatctgtggtgagggaccaatagtttttgcaatccatcacagaccaatactattataaaacacaacaaaaatgaatttctaagaaagttaaatggaaaaaagatatgcaaaataaaagcccaaatgtattagatttaacatgtaaaattacatttcgagataaacataacataaggggaaagaaacgaattgcaaaaagttggtaccctgtttgagacaagtccactcatcaatgtcaaattgccatagaaggttctaatcatactttgaataatactttgactagaccagcagcattgccatcatctgggaacttgttaggaatgcgaaattccaagccctacaccaattctgctgaatgagaatctgaattttaacaagatccctaggtgttttgtgtgcatgttaaagtttgagaagcactgggctagagttttgtgtaggggattcttttgcccctcaaattgaggaatcatcttctagtgtgtccagtcttcaaagaccttaaaacaaattgtgtctttgttttgtgatccagatggaatctgcagagatgcagtcctctcaaagtgttaaagctgtttattgaaagtaataaatgctgatttgcctggtacccaaaa

SEQ ID NO: 146059 - DNA, 508 bp, Homo sapiens
  Payload ID: 8965
  Gene Symbol: KIAA2022
  Gene Name: KIAA2022
  ENST ID: ENST00000424929
  CDS Start-End: 1-355
caaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtgctgaattttggcttggaatcaccaactctgcctgtattgtgatccccaagactccagacctcagagtcacctgctggcttagaggagtggagtgctttctatgtaatgaaaaggtgg

SEQ ID NO: 146060 - DNA, 10624 bp, Homo sapiens
  Payload ID: 8965
  Gene Symbol: KIAA2022
  Gene Name: KIAA2022
  Uniprot ID: Q5QGS0
  ENST ID: ENST00000616200
  CDS Start-End: 246-4796
ggggggacgaggcaggggaagaacctgggaaggaaaaccagtagcatcagcagcagcagtagcagcggcggtggcggctaaggcagctcgaacagctgcggcgacggcgacagcccagccttgactgcgaccgcgctagctacagcgcctgctgcctgagcccgccagcgacgtgcgcctcgggagtcggcctgtgaggttggacagcatttggacttggaatgaaacaataagaggttatattcatggataaccaacaagataaggctattgttgcctcagccaacggagaaaacactctgattaatggggtcaaagaaaatgactcagaggaccaggatgtggcaatgaagtcatttgcagctctagaagctgctgcacctatccagcctacaccggtggcacaaaaagagaccctgatgtatcccagaggtctcctgcctctaccctctaagaagccctgtatgcagagcccgccctctcctttgggcctgattgaagcacccgaacatgctgctaatagtgcttctgtgaatgccatctccctcacatctggcattgcaaaaggcctgaacacatggtcacttcccaatgaatgtgagaaagctccatttgccataatggagcctgcaggcatgtcagctctgaatggggactgtctcatgcagccaagtcggacttgcttaggctgcttcatggaatccaaggatgcagtagatcctgagccagggatcagtctgaaagttggtgatctaaatagggattatgaaacgtgtgcagtctctgatatagggattcagtgtattaatgctggagaaaatatgaaatatggagagcagctgctctcagaccagctcctaggcttccccctgcataagtcaagggcaggagacagacgagaaactgagaaacctgacattgacttggaggatccggctcagaaaagctattatgaggcattactgttagacaagtgcaatacagaagaagctttgcttgcaaattccaatcaggattggggttacttcgagacttttattagtgaaagtaagattgaactgcttgacctctgttccaaaaatgagctgtctgtcaacctattctctgaagaagatgtggataactacatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagggattccgactacaatctcctaaaagcagaaacaaccttttgggttttacctgtgtttgaagaagagactcgcattttccagaaagacatttgatgtttgtgttttatttctttcaaaatatgccttgtggtatgtatgttgacatgtaagtgcttaaagaaaagaattttaaattgtgggaatacgtctttggagcaaactttaatctcatgttctatgtaaaagacttaaaaagtcatacagttgcacaagtagtttatgcactatttacccacaaggaaaaaattgaaaacattgtgccaaactacaaacaagtgactgtactgtatatatttttacttctatatcaacatttggttgtatttggggaagttgtccctgttaatttactagaaacattccagtgattcttgctattaaccacccccacttatgtggatagcacctgtagatcatggtggaaaaatatgttgtgttacacaatttaccaaaattaaaggatactgtttgaaatgtgccaaattttcttacctcatctcacagattcacccacagtttaaagctcattaattatttttaaatggatatatacacacccaaacatatatatgtatatgtttgtgtgtgtgtgtgtgtgtgtatatatatgtatatatatatatacacacacacacgttcttttaaagttttagactctactgtcctgtgtggaaacatgaacagctaaacaaggcaaaataaagattttcttgttccattgtgtaagggttaaaattttggaaaagtctgaaggccacaacagctaagtccatcagggacccaagtatatgcatttacagaacgttttacaaggaaacaaaacagctgctttcaaagtttgttttctaaaagcaaaatctgtagctgaaaattatttaaagtgcaaagttatattgctgatactttatatctcagttttatatattttataatagtctgggataaattataaaaatagctataaaatcaacactaatgataaatgaagtatatagaatgcttttatttaaatagtttcctaaatgttttattccagttttgtcaaaagtgcactcatatcatggctttagtgttctttcagtgtttaatcttgcaatgccaatgtcatttaaagaaaatgttaaggcatcccagttcaaccaaatttttcttcttatgagtaaagtacatttactatcagataagatgaacaatttgtggcaacaactgatttgggccatatacccttagtctgaggataaccaatatttgatgccacacactaaacttaaatctcaattttaagtacaaatttttaaatcacattttttattcagtactccccctactttttaaaaaaaatttcacagccccaacattcctcactactactttttcttcccttttattcaccacttgacttctaacatttgatctcttttctttgcacaattgaaggcctgtgcatctgatgactgatgcattatggcacagatgagataatggatgtgagagcgctttgtagatcataaagtgctatacagatataggggattaatattattaatattgttagttgttgtcgttgttactattcttattaatattgttactaacctattaacttgtgaatatataggctggggtgggagggtggagaataagtgggaagggaaaaaggggatttaacaaaaaaagggaagatgtttcaaaaggaaaattttaagcaaaatatgaacctacctagtcaatgccacctaaatgtattcacaaacagagaagcaacatttgaaagtagtcagagagaaatggaaggaagcctgtcatgtatataagtatatacacttcccggtccatgattcctttcaccagcctgctctattccttacagctgggtcgtaaaatgaacaagcctgtgttcttgatcatgtgtgttcccagcgtcagtctcttgtgtctgtggggatgagtgggtgaggagcattctgtgaggctggtacaggcccattcctaggctttaatgctctgtttgcagtgagccctggaaaattacttagtggaaaggcaccagatgaaacatgtctcctgccccatagctaccattcaaaagggaaaataaccaaactggaaaaccttcttctatttctctattctgatagctagctgtactaaatgctatggccagtccctagaaactggtctttgttttgtttttgtttttgtttttgatttttctgttttgcagctgaattttggcttggaatcaccaactctgcctgtattgtgatccccaagactccagacctcagagtcacctgctggcttagaggagtggagtgctttctatgtaatgaaaaggtggcaattaatgaaaaaataaagaaaatgttccattaatacaatgtgtttttataaaagtaaatatgggagcagttgtcccagttttttttcggtatcagttcagctttggagaatggggtgtgagtggggtaggacagcctgaaactgttggaaacaatttccttgtgagaacttgctatcataagtcctttggaatggatattctttcagttgctcctatggagcccattaagggccaattctagggcatagttcatccctttctccaaagagaattgttattttaaagtacctttttaattggcctgcagtgtattatatgtttttaatatataaattagtgacgcataaccagtcactttgtactgaaacataaaaagaaacagagtttgagaaatgagcaataggccgaggcagaagatgtttattctcttaattgcatttaatattcctctcagtacattgtgttctgagatgttcatcatttagcattttgttggtcctgtctctgctctcacagttctttttcttcctgtcataaccagctgccttagtagagtataaaaatagtgttttgccctatcactggtatctcaagtcagaaatatatattatccttggtctgaaattcctgattaccgctcccttctaaccttccccctctgagaagctgtttcctattaatgcctccctaacagagtcccatttaatctttactttcctggaaatggtaacctcccttattcttcttacttaatctcagaccttggtcttagaatttttcttttatggtctcatatcccacctgcccaaattgtcagggctcaacaatcttaggctgctttcttctggaagttcagaaggaaaccttcccattcttaattgcctttaattgctttggctattttcaaatctaattttttaattaaattttttttaatttttatagagtaggggtacaaggacagttgtgttacatggatatattgcttagtgttgaaatctgggcttttagtgtacccatcaccgaaatagtgtacattgtacccaataggtggtatttcatccctcaaatataattttaaacacacactcgtgcccacatggacaaattatatcacatgactgaggaaacttagaaattccttttccctgaagatctgttaagaataggtctcatctcctgccctggttaggtgctatattatatggagaagggtattgagactttgggggtcatgtttgggctgtgataactggcttgaaccagtgaccatcctttctgcctcgccaaggtctcttataccagcttcttcacatatgctgcttcctcccagctttcccttctgacttcttgttactctgcaactatgtgtcaaggccttaccttttcctgatgttttcaaacctcctgcattactttgatcatcacttcttcagccatctcactgaagtccttggtgctagctgggcttttgtgacaactttcaccttctctgaactttttccttgctgggaagcatctgcgtgtgtgagggggctacggagggaagtgtgtgtgtgtgtaagagagaggcaaaaggatgcttcaaaagctataaacaactctagcaagcatcctaagtcctatgtgaggttttgcagttctagtgaatttctgttttagtaggtttcaattagcatttactgcctaaaggagaaaaaccatatccaaggaccttttagccatgcttgctattaccaagctggaccagtgtgatgtagatccaacatgtcttcagcttacagatgctctcagaacagttccaagaattgaagagagctaagtttttatgctgaagaggagaatggagcactagctagtcctaactattgctagaaatagaaatgtttattttctcctttattattgagaaattatctaatttaaggagtaaccattttcatttagggatttttttaatgactgcccatcactacagaaatatgttctttttataaaataaaactaatgtgaggttggtttgttttctaatcataaaattcactaagcctatagttacatttagaagatttagtaccaaaatcaaacttttagtaacaaacaggaatcttgtcaacacaatgtaggccagggattttgtaaaggtttctcaaagacccaaataagggagaaaaaaattttagttgggctgtttaacttgggaaacactgtcatcagcttgagggtcctcagccagcatgtgattattttgatgacaggactcaggctaccctttaaggcacattttttactcagcattaaacactagctacagtcgtgaagcagagctcccattgcagctacatacttgagatgtactcttggtttcagaatcgtaactaagaggtaaggcattggagaaggacaatgtaaaagacagaggtttagaacaaagtttatggtgtgaatgaggctttcaaaatcagtatctgggtaaattgatactaaagacactgaagaaacactcatccacataagatggaaaggatgtctgtccatctaacaagctcaggggtttctgagtctcagaatgacatcccatttcaaaaagaagaaaagagatattgaaatcattctgcctgtttgagagatgactggttatttacagcacaaaaaaaggcttagaatgaaaactagaagaggccttttgtttttcactcccagtgaggagagtagaaatcttaagatgctctactgggctacctgtagcactgactggagtttgctgcctacagagttttgaatgtactagtccttagtttccatagaactgaatgcacctctttagtaagttgctgatttatggtgctaaagaaaatgattattcccatttttttcttcttccccaagccccttaagcatttaagaaaatttaaaataaaagcgttagaggccctttttatgaatgtaacctaagtttctgtttgacatatgacactgcaacttaaaaatgttaggaaattatttgcctttttttttcttttagagttaagctttataaataatctgtagaatcaattgaagtttaaagcttaaggatcactcttaagacgtctacaaaatcttgtatatttttaagtgtgccaatttgtaacatattttgtaagtgtatatttttcttagaaaagtgctgtgaagtgtctgtatgtgagagttttcctttttctgcaccactaggtgctaataaaaggatatttacttcaaagtttctggttttagaaaccacaatacaaagaaaaaaaatacacttttgttggaaattttgtaacacaaaacatgttgtgaaagagtgtagtgatcttgtgcaaaaaaaatgaacatttgtgagcttcttgctgttttatagattttcttgtaaattattcttgtaacacttctggttttgttgttcttgttgcgaaggtttcaaatatttgtgactgaatgtacggtgaaactgtcataatgttacctagctgagttttgttattgtttatgaaataaataaaaagaaaagttt

SEQ ID NO: 146061 - DNA, 6884 bp, Homo sapiens
  Payload ID: 8966
  Gene Symbol: KIAA2026
  Gene Name: KIAA2026
  Uniprot ID: Q5HYC2
  ENST ID: ENST00000381461
  CDS Start-End: 1-6222
atgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctcttagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaaaagactctcctaagggagaaatcagtaagtctatagactcaacagaacctctggatatcctggagaaagatcactttgattcagatgatatgaagttgtcagaaatagattttcctatggctagaagcaagctgttgaaaaaggaattgccttcaaaagacttaccgaagacactgcttaaaacacttaaacgacagtccaaacaaactgattatgtggatgacagcacaaaagagctttctccaaggaagaaggcaaagttaagcacaaatgagacaacagttgagaatctagaaagtgatgtgcagattgactgtttcagtgaatcaaagcatacagagccatcatttccagagtcatttgcctcattggattcagtaccagtgtctactctccagaaagggaccaaacccattcaggctttgcttgcaaagaatattgggaataaagtgaccttaacaaatcaactgcctccttccacaggtagaaatgctcttgctgtggaaaaaccagttttatctcctccggaagcaagcccgataaagccagcattgacctgccacaccaatacaaaaggtcctttacaaatggtatacaaaatgccctgtggccagtggttgccaatagatcttcaaaatagctctgtaaagattcaggtgcagcctatggtggatcctaaaacaggagaaaaaatcatgcagcaagttcttattctgcctaagaattttgtgattcagcataaagaaggaaaagcagttgcaaaagaagtgccaccacttcaacagaaaggtacagaacaacattgttcatctttcccacagacaacaaatataaattcttctttagcatcagtttttgtcaactcaccaggaactgtttctacccaactaccaaatacagctttcaacaaaacaattacacctttatcaaatataagtagtgctagaccacagcctttgtcgcctgtaacctctgtaagtaacttattaacaccatcagttaagactagccagagtgaggcaggaaaagccaagaatgcagtttcagcagccacattctccttgcccagtgcttcaccgaccatttcctccacaggtcagcctctgtcatcaacaacaacactaaatgggtctacaaatcctggtagttccttcaactgttttgcacaacagactgctgattcttctgaagcaaagcaagagctgaaaactgtgtgcataagagattcacagtcaattcttgttaggacacgaggtgggaacactggagttgtaaaagtacagaccaacccagatcaaaattcacccaatactgtatcttcaagttcagttttcacttttgctcctcagctgcaggcatttctggtgccaaaatcaacaacttcttcctctgctttttcacctgtagctggaacaactactacatctagtctttcaccttttagccaaacaccaacttctgtttccattccagctagctttgccccatccatggggaaaaatctcaaacttacattaggccacaccactggcagtggtgatttgggccacgtgatagataaaacttcacacatgccctcttctcccttgaagtcctctatttgttctagtactctactaccatcaacaacaagtagttcggtaagtgtaattagcatatcagcagcaaattttggacaaaacaatgcaaatattattcatactccaactaaacagcaacaagtagattatatcacaaaaagttaccctgttacaaggtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcataaagcatatgttaagactccagagcaaccccaaatagtactgattccgtctacagtgggcacaccaataaaaataaattcatcaccagctgtgtctcagataaaggatgtgaaaattggactaaacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactcccataaaaattttcaatgtttattatactgttgaaagcatactatacattgtgtgtgtgtgtgtgtgtgtgtgtgtgtgtgtgtgtgtgttttaatgtatcttttcattagcttgcaacaaggctttgttttcttggggagggaaagatctgttccatttcacttactgttctgaggagggtttcaaggttctgtgtttaaagtcaggatttacctgtctgtagaacataaagtgaacaaagtttgaatagtttagagtaagctagccttttgcacatttacattgacatgtttcttcttgaatttggactgttgcagcatatctatgatatggtattcagtgtcattagtgaaatcttatttttgtttctgtaaaaaaaaaaatacatatatatatttatgcattgtgaaaaatgcagtccatgatgtaaaattgtacatattccagaatccctaacaacctgtactaaatatatgtacaaagaactatgctgtcttatttatgttttgtttacataatgtatagttttttaagtattttagtaattttggaccagtgaactgttagcaacaatgcagaagaatctgcatgtaataaactgagttgctgta

SEQ ID NO: 146062 - DNA, 6988 bp, Homo sapiens
  Payload ID: 8966
  Gene Symbol: KIAA2026
  Gene Name: KIAA2026
  Uniprot ID: Q5HYC2
  ENST ID: ENST00000399933
  CDS Start-End: 1-6312
atgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggcacttgagagaaaagacaacgatagcagttacatctagaggctattatggattggaggatgagaagggaactgcatgtacctcaacaaggcgtcggtcaacaccgcgaagtttggcaggcttgacaagtggagtttttgaatctataatggttcaagttttgagacaggaagaacagctgagagcaaaagaagaaaaaaggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctcttagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaagaaaaagaaaaaaaagaaattgaaagatgttttgaatgaaaacttacagagaaagcgtgaaggtcttcattctcttgcattcaagtcttacaaacctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcgggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaaaagactctcctaagggagaaatcagtaagtctatagactcaacagaacctctggatatcctggagaaagatcactttgattcagatgatatgaagttgtcagaaatagattttcctatggctagaagcaagctgttgaaaaaggaattgccttcaaaagacttaccgaagacactgcttaaaacacttaaacgacagtccaaacaaactgattatgtggatgacagcacaaaagagctttctccaaggaagaaggcaaagttaagcacaaatgagacaacagttgagaatctagaaagtgatgtgcagattgactgtttcagtgaatcaaagcatacagagccatcatttccagagtcatttgcctcattggattcagtaccagtgtctactctccagaaagggaccaaacccattcaggctttgcttgcaaagaatattgggaataaagtgaccttaacaaatcaactgcctccttccacaggtagaaatgctcttgctgtggaaaaaccagttttatctcctccggaagcaagcccgataaagccagcattgacctgccacaccaatacaaaaggtcctttacaaatggtatacaaaatgccctgtggccagtggttgccaatagatcttcaaaatagctctgtaaagattcaggtgcagcctatggtggatcctaaaacaggagaaaaaatcatgcagcaagttcttattctgcctaagaattttgtgattcagcataaagaaggaaaagcagttgcaaaagaagtgccaccacttcaacagaaaggtacagaacaacattgttcatctttcccacagacaacaaatataaattcttctttagcatcagtttttgtcaactcaccaggaactgtttctacccaactaccaaatacagctttcaacaaaacaattacacctttatcaaatataagtagtgctagaccacagcctttgtcgcctgtaacctctgtaagtaacttattaacaccatcagttaagactagccagagtgaggcaggaaaagccaagaatgcagtttcagcagccacattctccttgcccagtgcttcaccgaccatttcctccacaggtcagcctctgtcatcaacaacaacactaaatgggtctacaaatcctggtagttccttcaactgttttgcacaacagactgctgattcttctgaagcaaagcaagagctgaaaactgtgtgcataagagattcacagtcaattcttgttaggacacgaggtgggaacactggagttgtaaaagtacagaccaacccagatcaaaattcacccaatactgtatcttcaagttcagttttcacttttgctcctcagctgcaggcatttctggtgccaaaatcaacaacttcttcctctgctttttcacctgtagctggaacaactactacatctagtctttcaccttttagccaaacaccaacttctgtttccattccagctagctttgccccatccatggggaaaaatctcaaacttacattaggccacaccactggcagtggtgatttgggccacgtgatagataaaacttcacacatgccctcttctcccttgaagtcctctatttgttctagtactctactaccatcaacaacaagtagttcggtaagtgtaattagcatatcagcagcaaattttggacaaaacaatgcaaatattattcatactccaactaaacagcaacaagtagattatatcacaaaaagttaccctgttacaaggtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcataaagcatatgttaagactccagagcaaccccaaatagtactgattccgtctacagtgggcacaccaataaaaataaattcatcaccagctgtgtctcagataaaggatgtgaaaattggactaaacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactcccataaaaattttcaatgtttattatactgttgaaagcatactatacattgtgtgtgtgtgtgtgtgtgtgtgtgtgtgtgtgtgtgtgttttaatgtatcttttcattagcttgcaacaaggctttgttttcttggggagggaaagatctgttccatttcacttactgttctgaggagggtttcaaggttctgtgtttaaagtcaggatttacctgtctgtagaacataaagtgaacaaagtttgaatagtttagagtaagctagccttttgcacatttacattgacatgtttcttcttgaatttggactgttgcagcatatctatgatatggtattcagtgtcattagtgaaatcttatttttgtttctgtaaaaaaaaaaatacatatatatatttatgcattgtgaaaaatgcagtccatgatgtaaaattgtacatattccagaatccctaacaacctgtactaaatatatgtacaaagaactatgctgtcttatttatgttttgtttacataatgtatagttttttaagtattttagtaattttggaccagtgaactgttagcaacaatgcagaagaatctgcatgtaataaactgagttgctgtatttctttgtttgaa

SEQ ID NO: 146063 - DNA, 932 bp, Homo sapiens
  Payload ID: 8966
  Gene Symbol: KIAA2026
  Gene Name: KIAA2026
  ENST ID: ENST00000436015
  CDS Start-End: 1-622
tcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccagtgagctttctcttaagtgtgccaagctgccatccaactttcttgagcattttttctcatgggaaatgatcaagttttgatagcagaaagtgcttctttccaagactttctcgaggccatcttcctgtaggcgtcatgcttctgatgttacacagctgatattttcatatgagctgcatttttagactacaaagatgcttactcagactcagcccaagtctccatgtccatcacctgggacactgtctgaggaactctgtgaggagagccttttccacagagaaatgagagcaccctcagtatcgctctgaagacttgatgaaggtttgctgacaagaaagggcttactcactgtacacagcccttcaataactcctac

SEQ ID NO: 146064 - DNA, 4346 bp, Homo sapiens
  Payload ID: 8966
  Gene Symbol: KIAA2026
  Gene Name: KIAA2026
  ENST ID: ENST00000540714
  CDS Start-End: 1-395
ctgagatccagaataagttattgatcatcaaaaaaaaagcaaaacacaagaagcacaaatctggaaaaaaatccgtctctaaaaaagcaatcacaaagaagaggaaaactgtcataaagtcacctactgtaccagagtttcagcttatttgcactaatcttgatgaactcagggaattaatcacaaaaatcgagaatgaactcaaagatctggaaaacagtagaaaaaaatcggtatccaatgtccccagcatcagtagattgccaactccctctccttgccacactccagccagtgttatgctggtgctgtcatacccatcccagattactgtagcagaatgcagttgttctttagttgtgagggaaaatggtatcatcggaggcaagctgtaaaagaattacatagtacattgatacgtcttttaaatgaattgctgccatgggaaccaaagttaatgaaggctttccaaagaaacaggagccgcctgaagaaagactatgatgatttcagaagacaacctgatcatgatacatttaatagagaactatggaccactgatgaaggtgaaggagatcttggaaaagactctcctaagggagaaatcagtaagtctatagactcaacagaacctctggatatcctggagaaagatcactttgattcagatgatatgaagttgtcagaaatagattttcctatggctagaagcaagctgttgaaaaaggaattgccttcaaaagacttaccgaagacactgcttaaaacacttaaacgacagtccaaacaaactgattatgtggatgacagcacaaaagagctttctccaaggaagaaggcaaagttaagcacaaatgagacaacagttgagaatctagaaagtgatgtgcagattgactgtttcagtgaatcaaagcatacagagccatcatttccagagtcatttgcctcattggattcagtaccagtgtctactctccagaaagggaccaaacccattcaggctttgcttgcaaagaatattgggaataaagtgaccttaacaaatcaactgcctccttccacaggtagaaatgctcttgctgtggaaaaaccagttttatctcctccggaagcaagcccgataaagccagcattgacctgccacaccaatacaaaaggtcctttacaaatggtatacaaaatgccctgtggccagtggttgccaatagatcttcaaaatagctctgtaaagattcaggtgcagcctatggtggatcctaaaacaggagaaaaaatcatgcagcaagttcttattctgcctaagaattttgtgattcagcataaagaaggaaaagcagttgcaaaagaagtgccaccacttcaacagaaaggtacagaacaacattgttcatctttcccacagacaacaaatataaattcttctttagcatcagtttttgtcaactcaccaggaactgtttctacccaactaccaaatacagctttcaacaaaacaattacacctttatcaaatataagtagtgctagaccacagcctttgtcgcctgtaacctctgtaagtaacttattaacaccatcagttaagactagccagagtgaggcaggaaaagccaagaatgcagtttcagcagccacattctccttgcccagtgcttcaccgaccatttcctccacaggtcagcctctgtcatcaacaacaacactaaatgggtctacaaatcctggtagttccttcaactgttttgcacaacagactgctgattcttctgaagcaaagcaagagctgaaaactgtgtgcataagagattcacagtcaattcttgttaggacacgaggtgggaacactggagttgtaaaagtacagaccaacccagatcaaaattcacccaatactgtatcttcaagttcagttttcacttttgctcctcagctgcaggcatttctggtgccaaaatcaacaacttcttcctctgctttttcacctgtagctggaacaactactacatctagtctttcaccttttagccaaacaccaacttctgtttccattccagctagctttgccccatccatggggaaaaatctcaaacttacattaggccacaccactggcagtggtgatttgggccacgtgatagataaaacttcacacatgccctcttctcccttgaagtcctctatttgttctagtactctactaccatcaacaacaagtagttcggtaagtgtaattagcatatcagcagcaaattttggacaaaacaatgcaaatattattcatactccaactaaacagcaacaagtagattatatcacaaaaagttaccctgttacaaggtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcataaagcatatgttaagactccagagcaaccccaaatagtactgattccgtctacagtgggcacaccaataaaaataaattcatcaccagctgtgtctcagataaaggatgtgaaaattggactaaacataggtcaagcaattgtaaatacttcaggcactgtgccagctataccatcaattaacatattacaaaatgtaaccccaaaaggagaagacaaaagtagcaagggctatattttgccattgtcaacaagtggtaattcagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtggccaacctctacaacatcctctaagaagccctacaaaatttataaactcttttgggaatgcaagttctatacccacagtacatacatcaccacaactcataaacacaactgctaaggttcctgttccacctcctgtaccaacagtatcactgacttcagtaattaagtctccagctactcttttggctaagacatctttggtttctgccatttgccccagtaatcctccactgccaagtagcacttcagtgtttcatttggacccacctgtcaaaaaattgttggttagcccagaaggagccattttgaataccataaatactccagcatctaaggtttcttcactctctccatctctctctcagattgttgtatctgccagtcgaagtcctgcgtctgtcttccctgcttttcagtcgtcgggcttagagaagcctgacagagctgcatcttgaatttagactaaaagagccagtttttaaataatggggcattgttttgactccc

SEQ ID NO: 146065 - DNA, 1967 bp, Homo sapiens
  Payload ID: 8966
  Gene Symbol: KIAA2026
  Gene Name: KIAA2026
  ENST ID: ENST00000513355
  CDS Start-End: 115-1967
gatgtggcgggggctacgcgccgcggccgagccgtgaggaagcggctcgcgctcacgcgtcccccagcacctcgagcggctgttccacaccgcccagcctaggcctgccggggcatgagtgtgcccgggacgccgggagcgatggagccggctggggaggaagagcggccgccaccggcggccgaaggagaggacgacgaggaggaggtggcagcggcggcccagacctcagggccggcccacggaaggagtgcctcctcgctggaggacgcggacgatcaggaggaagagatggaggcgatggtgatcggaggcggttgctgcaaggagcaggagctgacctacgagctacagcagggctaccgcatcctgggcgagttcctgcaggagaagcaccggggcctcaccgccccctttctgcagcccttggggggcgttgccaccgcggaggaggaggtggcggaagggccgcgcagcgggggccggggcggtcgcgccttcccgcagcagcccggacagggcatgtgtctgctgcagatggaagagaagttcgccagcggccagtacgggggcatcaccgagttcgtggcggacttcaggttgatgctggagacgtgctaccgcctgcacggagtggaccactggatctccaaacagggccagaagctggagatgatgctggagcagaagttagcgcttctctctcggcttcgggagcaggaaagaaaagaagcagaagaagctagtcaaaaggaaatagaagaatgggaaagaaaacttctagctcaagcagctccaacttgtatggagaccatgtgggaaattccagctattgggcatttcctttgtttagctcagcaaattctaaatttgccagaaatagtcttttacgaattggaacgttgtcttctgatgcctcagtgtaatgcttttctatcgaaaataatgacttctctattaagtcctccccatcgcagacctaccttacatcgaagacctactttgccttataggacctgggaagcagcgctgaggcagaaagtacaacagtggtacactgctgtagggcaaactgaaaatcctgataactgtgctgaaaaactggggttgtgtcctcagttttttaaagttcttggagaagttaatccattggaagaaaaaccttttcacgaactacctttttaccaaaaagtgtggctacttaagggtctttgtgactttgtgtatgaaacacaaaaggaagttcaagatgctgtacttggacagcctatccatgaatgcagggaagttattcttggttatgattatttggagaatgcttatgtacattttccacagttctgtggtgcagatgtacggatttataaacagagaccctttcaggccccagaatttccaattccacccattaaaatacaaagagtacctcggattaaattggagaaattgaagtgtgactatgttagtacaagtaatggagaacatagatgtagcagagatagcctgccctcttccttcaagaaagagcaggaaaataattttgatccagcttgctgtcctgctaaaatgatcttggataatcatgacatctctgttgaaatgggagtaaaatccaactatgaaattagaattcgcaggccttgtgaaattaaaaaaactgattgttgtaaagaaaatttagagaaaccaaggagtccaggggaagttactggctttggagagcctcttagtccaggtgaaataaggtttatagaaaatcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaaaatgagggcaaaaaagaa

SEQ ID NO: 146066 - DNA, 1382 bp, Homo sapiens
  Payload ID: 8967
  Gene Symbol: KAAG1
  Gene Name: kidney associated antigen 1
  Uniprot ID: Q9UBP8
  ENST ID: ENST00000274766
  CDS Start-End: 738-992
cattatgctaacagcataaacatgcagggggtgggagcagggtcacaaaagtgagtgttgtcaattctacttggaatgaaaggttgaaataatttaaacagtacgggaaatgcagagcaattttctcctctggtgacaatatagtgtccaacacttggaagtgatttttaagaatgtttatttaaattaaaaggatggatttccaaggaaaaaaaataaggaaaaggaaagaaaaaactgaacagaaaacgcaaaagtatcagtttggtcactaacctttgcaaggatacctttttattttctttaagattcctgttgtttatacacagattttaagtttactcctactgctgacccaagtgaaattccttctccagtcacagtgtcaacctctaccccccaactgcaacgagagttttgaggggcatcaatcacaccgagaagtcacagcccctcaaccactgaggtgtgggggggtagggatctgcatttcttcatatcaaccccacactatagggcacctaaatgggtgggcggtgggggagaccgactcacttgagtttcttgaaggcttcctggcctccagccacgtaattgcccccgctctggatctggtctagcttccggattcggtggccagtccgcggggtgtagatgttcctgacggccccaaagggtgcctgaacgccgccggtcacctccttcaggaagacttcgaagctggacaccttcttctcatggatgacgacgcggcgccccgcgtagaaggggtccccgttgcggtacacaagcacgctcttcacgacgggctgagacaggtggctggacctggcgctgctgccgctcatcttccccgctggccgccgcctcagctcgctgcttcgcgtcgggaggcacctccgctgtcccagcggcctcaccgcacccagggcgcgggatcgcctcctgaaacgaacgagaaactgacgaatccacaggtgaaagagaagtaacggccgtgcgcctaggcgtccacccagaggagacactaggagcttgcaggactcggagtagacgctcaagtttttcaccgtggcgtgcacagccaatcaggacccgcagtgcgcgcaccacaccaggttcacctgctacgggcagaatcaaggtggacagcttctgagcaggagccggaaacgcgcggggccttcaaacaggcacgcctagtgagggcaggagagaggaggacgcacacacacacacacacacaaatatggtgaaacccaatttcttacatcatatctgtgctaccctttccaaacagcctaatttttcttttctctcttcttgcacctttacccctcaatctcctgcttgctcccaaattaaagcaattaagttcctgg

SEQ ID NO: 146067 - DNA, 4853 bp, Homo sapiens
  Payload ID: 8968
  Gene Symbol: KCP
  Gene Name: kielin/chordin-like protein
  ENST ID: ENST00000613019
  CDS Start-End: 44-4750
gagccgcgacgacagacggcgagccgagcgaggcggagctagcatggccggggtcggggccgctgcgctgtcccttctcctgcacctcggggccctggcgctggccgcgggcgcggaaggtggggctgtccccagggagccccctgggcagcagacaactgcccattcctcagtccttgctgggaactcccaggagcagtggcaccccctgcgagagtggctggggcgactggaggctgcagtgatggagctcagagaacagaataaggacctgcagacgagggtgaggcagctggagtcctgtgagtgccaccctgcatctccccagtgctgggggctggggcgtgcctggcccgagggggcacgctgggagcctgacgcctgcacagcctgcgtctgccaggatggggccgctcactgtggcccccaagcacacctgccccattgcaggggctgcagccaaaatggccagacctacggcaacggggagaccttctccccagatgcctgcaccacctgccgctgtctgacaggagccgtgcagtgccaggggccctcgtgttcagagctcaactgcttggagagctgcaccccacctggggagtgctgccccatctgccggcccggctgtgattatgaggggcagctttatgaggagggggtcaccttcctgtccagctccaacccttgtctacagtgcacctgcctgaggagccgagttcgctgcatggccctgaagtgcccgcctagcccctgcccagagccagtgctgaggcctgggcactgctgcccaacctgccaaggctgcacagaaggtggctctcactgggaacatggccaagagtggacaacacctggggacccctgccgaatctgccggtgcctggagggtcacatccagtgccgccagcgagaatgtgccagcctgtgtccatacccagcccggcccctcccaggcacctgctgccctgtgtgtgatggctgtttcctaaacgggcgggagcaccgcagcggggagcctgtgggctcaggggacccctgctcgcactgccgctgtgctaatgggagtgtccagtgtgagcctctgccctgcccgccagtgccctgcagacacccaggcaagatccctgggcagtgctgccctgtctgcgatggctgtgagtaccagggacaccagtatcagagccaggagaccttcagactccaagagcggggcctctgtgtccgctgctcctgccaggctggcgaggtctcctgtgaggagcaggagtgcccagtcaccccctgtgccctgcctgcctctggccgccagctctgcccagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagccgccccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggctgtgagtacctgggggagtcctacctgagtaaccaggagttcccagacccccgagaaccctgcaacctgtgtacctgtcttggaggcttcgtgacctgcggccgccggccctgtgagcctccgggctgcagccacccactcatcccctctgggcactgctgcccgacctgccagggatgccgctaccatggcgtcactactgcctccggagagacccttcctgacccacttgaccctacctgctccctctgcacctgccaggaaggttccatgcgctgccagaagaagccatgtcccccagctctctgcccccacccctctccaggcccctgcttctgccctgtttgccacagctgtctctctcagggccgggagcaccaggatggggaggagtttgagggaccagcaggcagctgtgagtggtgtcgctgtcaggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccccctgggccccagcactgctgtcccacctgtgccgaggccttgagtaactgttcagagggcctgctgggatctgagctagccccaccagacccctgctacacgtgccagtgccaggacctgacatggctctgcatccaccaggcttgtcctgagctcagctgtcccctctcagagcgccacactccccctgggagctgctgccccgtatgccgggctcccacccagtcctgcgtgcaccagggccgtgaggtggcctctggagagcgctggactgtggacacctgcaccagctgctcctgcatggcgggcaccgtgcgttgccagagccagcgctgctcaccgctctcgtgtggccccgacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtctcagaggggctgtggcctggccggccctgttctgcaggccgagaggtggatccgtgccgggcagcaggttaccgtgccaggcgtgaggccaatgcccggtgtggggtgctgaagtcctccccattcagtcgctgccatgctgtggtgccaccggagcccttctttgccgcctgtgtgtatgacctgtgtgcctgtggccctggctcctccgctgatgcctgcctctgtgatgccctggaagcctacgccagtcactgtcgccaggcaggagtgacacctacctggcgaggccccacgctgtgtgtggtaggctgccccctggagcgtggcttcgtgtttgatgagtgcggcccaccctgtccccgcacctgcttcaatcagcatatccccctgggggagctggcagcccactgcgtgaggccctgcgtgcccggctgccagtgccctgcaggcctggtggagcatgaggcccactgcatcccacccgaggcctgcccccaagtcctgctcactggagaccagccacttggtgctcggcccagccccagccgggagccccaggagacaccctgagccaggacagtgcctgataagggttcatcaggccaggagtctccccttggcgagcagttcccaccctggttagggctatggagagaatgccctgcctggacac

SEQ ID NO: 146068 - DNA, 5108 bp, Homo sapiens
  Payload ID: 8968
  Gene Symbol: KCP
  Gene Name: kielin/chordin-like protein
  ENST ID: ENST00000610776
  CDS Start-End: 44-4930
gagccgcgacgacagacggcgagccgagcgaggcggagctagcatggccggggtcggggccgctgcgctgtcccttctcctgcacctcggggccctggcgctggccgcgggcgcggaaggtggggctgtccccagggagccccctgggcagcagacaactgcccattcctcagtccttgctgggaactcccaggagcagtggcaccccctgcgagagtggctggggcgactggaggctgcagtgatggagctcagagaacagaataaggacctgcagacgagggtgaggcagctggagtcctgtgagtgccaccctgcatctccccagtgctgggggctggggcgtgcctggcccgagggggcacgctgggagcctgacgcctgcacagcctgcgtctgccaggatggggccgctcactgtggcccccaagcacacctgccccattgcaggggctgcagccaaaatggccagacctacggcaacggggagaccttctccccagatgcctgcaccacctgccgctgtctggaaggtaccatcacttgcaaccagaagccatgcccaagaggaccctgccctgagccaggagcatgctgcccgcactgtaagccaggctgtgattatgaggggcagctttatgaggagggggtcaccttcctgtccagctccaacccttgtctacagtgcacctgcctgaggagccgagttcgctgcatggccctgaagtgcccgcctagcccctgcccagagccagtgctgaggcctgggcactgctgcccaacctgccaaggctgcacagaaggtggctctcactgggaacatggccaagagtggacaacacctggggacccctgccgaatctgccggtgcctggagggtcacatccagtgccgccagcgagaatgtgccagcctgtgtccatacccagcccggcccctcccaggcacctgctgccctgtgtgtgatggctgtttcctaaacgggcgggagcaccgcagcggggagcctgtgggctcaggggacccctgctcgcactgccgctgtgctaatgggagtgtccagtgtgagcctctgccctgcccgccagtgccctgcagacacccaggcaagatccctgggcagtgctgccctgtctgcgatggctgtgagtaccagggacaccagtatcagagccaggagaccttcagactccaagagcggggcctctgtgtccgctgctcctgccaggctggcgaggtctcctgtgaggagcaggagtgcccagtcaccccctgtgccctgcctgcctctggccgccagctctgcccagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagccgccccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggctgtgagtacctgggggagtcctacctgagtaaccaggagttcccagacccccgagaaccctgcaacctgtgtacctgtcttggaggcttcgtgacctgcggccgccggccctgtgagcctccgggctgcagccacccactcatcccctctgggcactgctgcccgacctgccagggatgccgctaccatggcgtcactactgcctccggagagacccttcctgacccacttgaccctacctgctccctctgcacctgccaggaaggttccatgcgctgccagaagaagccatgtcccccagctctctgcccccacccctctccaggcccctgcttctgccctgtttgccacagctgtctctctcagggccgggagcaccaggatggggaggagtttgagggaccagcaggcagctgtgagtggtgtcgctgtcaggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccccctgggccccagcactgctgtcccacctgtgccgaggccttgagtaactgttcagagggcctgctgggatctgagctagccccaccagacccctgctacacgtgccagtgccaggacctgacatggctctgcatccaccaggcttgtcctgagctcagctgtcccctctcagagcgccacactccccctgggagctgctgccccgtatgccgggaatgtgtggtggaggccgagggccggagagtggcagatggagagagctggcgggaccccagcaatgcgtgcatcgcctgcacctgccatcggggccatgtggagtgccacctcgaggagtgccaggccctctcctgcccccatggctgggcgaaggtgccccaggctgacagctgctgtgagcgatgccaagctcccacccagtcctgcgtgcaccagggccgtgaggtggcctctggagagcgctggactgtggacacctgcaccagctgctcctgcatggcgggcaccgtgcgttgccagagccagcgctgctcaccgctctcgtgtggccccgacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtctcagaggggctgtggcctggccggccctgttctgcaggccgagaggtggatccgtgccgggcagcaggttaccgtgccaggcgtgaggccaatgcccggtgtggggtgctgaagtcctccccattcagtcgctgccatgctgtggtgccaccggagcccttctttgccgcctgtgtgtatgacctgtgtgcctgtggccctggctcctccgctgatgcctgcctctgtgatgccctggaagcctacgccagtcactgtcgccaggcaggagtgacacctacctggcgaggccccacgctgtgtgtggtaggctgccccctggagcgtggcttcgtgtttgatgagtgcggcccaccctgtccccgcacctgcttcaatcagcatatccccctgggggagctggcagcccactgcgtgaggccctgcgtgcccggctgccagtgccctgcaggcctggtggagcatgaggcccactgcatcccacccgaggcctgcccccaagtcctgctcactggagaccagccacttggtgctcggcccagccccagccgggagccccaggagacaccctgagccaggacagtgcctgataagggttcatcaggccaggagtctccccttggcgagcagttcccaccctggttagggctatggagagaatgccctgcctggacactggagcctgggcccctgccctgcaaagacccccgccatgttgagtcaccagcagtaaactctaggcctgcccgaa

SEQ ID NO: 146069 - DNA, 4741 bp, Homo sapiens
  Payload ID: 8968
  Gene Symbol: KCP
  Gene Name: kielin/chordin-like protein
  ENST ID: ENST00000611280
  CDS Start-End: 44-3871
gagccgcgacgacagacggcgagccgagcgaggcggagctagcatggccggggtcggggccgctgcgctgtcccttctcctgcacctcggggccctggcgctggccgcgggcgcggaaggtggggctgtccccagggagccccctgggcagcagacaactgcccattcctcagtccttgctgggaactcccaggagcagtggcaccccctgcgagagtggctggggcgactggaggctgcagtgatggagctcagagaacagaataaggacctgcagacgagggtgaggcagctggagtcctgtgagtgccaccctgcatctccccagtgctgggggctggggcgtgcctggcccgagggggcacgctgggagcctgacgcctgcacagcctgcgtctgccaggatggggccgctcactgtggcccccaagcacacctgccccattgcaggggctgcagccaaaatggccagacctacggcaacggggagaccttctccccagatgcctgcaccacctgccgctgtctgacaggagccgtgcagtgccaggggccctcgtgttcagagctcaactgcttggagagctgcaccccacctggggagtgctgccccatctgccggcccggctgtgattatgaggggcagctttatgaggagggggtcaccttcctgtccagctccaacccttgtctacagtgcacctgcctgaggagccgagttcgctgcatggccctgaagtgcccgcctagcccctgcccagagccagtgctgaggcctgggcactgctgcccaacctgccaaggctgcacagaaggtggctctcactgggaacatggccaagagtggacaacacctggggacccctgccgaatctgccggtgcctggagggtcacatccagtgccgccagcgagaatgtgccagcctgtgtccatacccagcccggcccctcccaggcacctgctgccctgtgtgtgatggctgtttcctaaacgggcgggagcaccgcagcggggagcctgtgggctcaggggacccctgctcgcactgccgctgtgctaatgggagtgtccagtgtgagcctctgccctgcccgccagtgccctgcagacacccaggcaagatccctgggcagtgctgccctgtctgcgatggctgtgagtaccagggacaccagtatcagagccaggagaccttcagactccaagagcggggcctctgtgtccgctgctcctgccaggctggcgaggtctcctgtgaggagcaggagtgcccagtcaccccctgtgccctgcctgcctctggccgccagctctgcccagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagccgccccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggctgtgagtacctgggggagtcctacctgagtaaccaggagttcccagacccccgagaaccctgcaacctgtgtacctgtcttggaggcttcgtgacctgcggccgccggccctgtgagcctccgggctgcagccacccactcatcccctctgggcactgctgcccgacctgccagggatgccgctaccatggcgtcactactgcctccggagagacccttcctgacccacttgaccctacctgctccctctgcacctgccaggaaggttccatgcgctgccagaagaagccatgtcccccagctctctgcccccacccctctccaggcccctgcttctgccctgtttgccacagctgtctctctcagggccgggagcaccaggatggggaggagtttgagggaccagcaggcagctgtgagtggtgtcgctgtcaggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccccctgggccccagcactgctgtcccacctgtgccgaggccttgagtaactgttcagagggcctgctgggatctgagctagccccaccagacccctgctacacgtgccagtgccaggacctgacatggctctgcatccaccaggcttgtcctgagctcagctgtcccctctcagagcgccacactccccctgggagctgctgccccgtatgccgggctcccacccagtcctgcgtgcaccagggccgtgaggtggcctctggagagcgctggactgtggacacctgcaccagctgctcctgcatggcgggcaccgtgcgttgccagagccagcgctgctcaccgctctcgtgtggccccgacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcaggtggatgggcacccggtggccttgcccttcctgcaggagccgctgctgtatgtggagctgcgaggacacactgtgatcctgcacgcccagcccgggctccaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtctcagaggggctgtggcctggccggccctgttctgcaggccgagaggtggatccgtgccgggcagcaggttaccgtgccaggcgtgaggccaatgcccggtgtggggtgctgaagtcctccccattcagtcgctgccatgctgtggtgccaccggagcccttctttgccgcctgtgtgtatgacctgtgtgcctgtggccctggctcctccgctgatgcctgcctctgtgatgccctggaagcctacgccagtcactgtcgccaggcaggagtgacacctacctggcgaggccccacgctgtgtgtggtaggctgccccctggagcgtggcttcgtgtttgatgagtgcggcccaccctgtccccgcacctgcttcaatcagcatatccccctgggggagctggcagcccactgcgtgaggccctgcgtgcccggctgccagtgccctgcaggcctggtggagcatgaggcccactgcatcccacccgaggcctgcccccaagtcctgctcactggagaccagccacttggtgctcggcccagccccagccgggagccccaggagacaccctgagccaggacagtgcctgataagggttcatcaggccaggagtctccccttggcgagcagttcccaccctggttagggctatggagagaatgccctgcctggacac

SEQ ID NO: 146070 - DNA, 4515 bp, Homo sapiens
  Payload ID: 8968
  Gene Symbol: KCP
  Gene Name: kielin/chordin-like protein
  ENST ID: ENST00000620378
  CDS Start-End: 1-4515
atggccggggtcggggccgctgcgctgtcccttctcctgcacctcggggccctggcgctggccgcgggcgcggaaggtggggctgtccccagggagccccctgggcagcagacaactgcccattcctcagtccttgctgggaactcccaggagcagtggcaccccctgcgagagtggctggggcgactggaggctgcagtgatggagctcagagaacagaataaggacctgcagacgagggtgaggcagctggagtcctgtgagtgccaccctgcatctccccagtgctgggggctggggcgtgcctggcccgagggggcacgctgggagcctgacgcctgcacagcctgcgtctgccaggatggggccgctcactgtggcccccaagcacacctgccccattgcaggggctgcagccaaaatggccagacctacggcaacggggagaccttctccccagatgcctgcaccacctgccgctgtctgacaggagccgtgcagtgccaggggccctcgtgttcagagctcaactgcttggagagctgcaccccacctggggagtgctgccccatctgccgctgcacagaaggtggctctcactgggaacatggccaagagtggacaacacctggggacccctgccgaatctgccggtgcctggagggtcacatccagtgccgccagcgagaatgtgccagcctgtgtccatacccagcccggcccctcccaggcacctgctgccctgtgtgtgatggctgtttcctaaacgggcgggagcaccgcagcggggagcctgtgggctcaggggacccctgctcgcactgccgctgtgctaatgggagtgtccagtgtgagcctctgccctgcccgccagtgccctgcagacacccaggcaagatccctgggcagtgctgccctgtctgcgatggctgtgagtaccagggacaccagtatcagagccaggagaccttcagactccaagagcggggcctctgtgtccgctgctcctgccaggctggcgaggtctcctgtgaggagcaggagtgcccagtcaccccctgtgccctgcctgcctctggccgccagctctgcccagcctgtgagctggatggagaggagtttgctgagggagtccagtgggagcctgatggtcggccctgcaccgcctgcgtctgtcaagatggggtacccaagtgcggggctgtgctctgccccccagccccctgccagcaccccacccagccccctggtgcctgctgccccagctgtgacagctgcacctaccacagccaagtgtatgccaatgggcagaacttcacggatgcagacagcccttgccatgcctgccactgtcaggatggaactgtgacatgctccttggttgactgccctcccacgacctgtgccaggccccagagtggaccaggccagtgttgccccaggtgcccagactgcatcctggaggaagaggtgtttgtggacggcgagagcttctcccacccccgagacccctgccaggagtgccgatgccaggaaggccatgcccactgccagcctcgcccctgccccagggccccctgtgcccacccgctgcctgggacctgctgcccgaacgactgcagcggctgtgcctttggcgggaaagagtaccccagcggagcggacttcccccacccctctgacccctgccgtctgtgtcgctgtctgagcggcaacgtgcagtgcctggcccgccgctgcgtgccgctgccctgtccagagcctgtcctgctgccgggagagtgctgcccgcagtgcccagcccccgccggctgcccacggcccggcgcggcccacgcccgccaccaggagtacttctccccgcccggcgatccctgccgccgctgcctctgcctcgacggctccgtgtcctgccagcggctgccctgcccgcccgcgccctgcgcgcacccgcgccaggggccttgctgcccctcctgcgacggctgcctgtaccaggggaaggagtttgccagcggggagcgcttcccatcgcccactgctgcctgccacctctgcctttgctgggagggcagcgtgagctgcgagcccaaggcatgtgcccctgcactgtgccccttccctgccaggggcgactgctgccctgactgtgatggctgtgagtacctgggggagtcctacctgagtaaccaggagttcccagacccccgagaaccctgcaacctgtgtacctgtcttggaggcttcgtgacctgcggccgccggccctgtgagcctccgggctgcagccacccactcatcccctctgggcactgctgcccgacctgccagggatgccgctaccatggcgtcactactgcctccggagagacccttcctgacccacttgaccctacctgctccctctgcacctgccaggaaggttccatgcgctgccagaagaagccatgtcccccagctctctgcccccacccctctccaggcccctgcttctgccctgtttgccacagctgtctctctcagggccgggagcaccaggatggggaggagtttgagggaccagcaggcagctgtgagtggtgtcgctgtcaggctggccaggtcagctgtgtgcggctgcagtgcccaccccttccctgcaagctccaggtcaccgagcgggggagctgctgccctcgctgcagaggctgcctggctcatggggaagagcaccccgaaggcagtagatgggtgccccccgacagtgcctgctcctcctgtgtgtgtcacgagggcgtcgtcacctgtgcacgcatccagtgcatcagctcttgcgcccagccccgccaagggccccatgactgctgtcctcaatgctctgactgtgagcatgagggccggaagtacgagcctggggagagcttccagcctggggcagacccctgtgaagtgtgcatctgcgagccacagcctgaggggcctcccagccttcgctgtcaccggcggcagtgtcccagcctggtgggctgcccccccagccagctcctgccccctgggccccagcactgctgtcccacctgtgccgaggccttgagtaactgttcagagggcctgctgggatctgagctagccccaccagacccctgctacacgtgccagtgccaggacctgacatggctctgcatccaccaggcttgtcctgagctcagctgtcccctctcagagcgccacactccccctgggagctgctgccccgtatgccgggctcccacccagtcctgcgtgcaccagggccgtgaggtggcctctggagagcgctggactgtggacacctgcaccagctgctcctgcatggcgggcaccgtgcgttgccagagccagcgctgctcaccgctctcgtgtggccccgacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgctgtgggatgggcagtcccaggtggaggtgagcgtacctggctcctaccagggccggacttgtgggctctgtgggaacttcaatggctttgcccaggacgatctgcagggccctgaggggctgctcctgccctcggaggctgcgtttgggaatagctggcaggtctcagaggggctgtggcctggccggccctgttctgcaggccgagaggtggatccgtgccgggcagcaggttaccgtgccaggcgtgaggccaatgcccggtgtggggtgctgaagtcctccccattcagtcgctgccatgctgtggtgccaccggagcccttctttgccgcctgtgtgtatgacctgtgtgcctgtggccctggctcctccgctgatgcctgcctctgtgatgccctggaagcctacgccagtcactgtcgccaggcaggagtgacacctacctggcgaggccccacgctgtgtgtggtaggctgccccctggagcgtggcttcgtgtttgatgagtgcggcccaccctgtccccgcacctgcttcaatcagcatatccccctgggggagctggcagcccactgcgtgaggccctgcgtgcccggctgccagtgccctgcaggcctggtggagcatgaggcccactgcatcccacccgaggcctgcccccaagtcctgctcactggagaccagccacttggtgctcggcccagccccagccgggagccccaggagacaccctga

SEQ ID NO: 146071 - DNA, 2544 bp, Homo sapiens
  Payload ID: 8969
  Gene Symbol: KIF1BP
  Gene Name: KIF1 binding protein
  Uniprot ID: Q96EK5
  ENST ID: ENST00000361983
  CDS Start-End: 113-1978
attccacagcggccgcaacgtgtcgagagccgtaagtaaagtgtcgcaaagcagaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacggcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacactcctgaagctgaaggagaagtgccagagctttatcatcaaagaaagggggaaatagcaaggtgctggatcaaatactgtttgactctcatgcagaatgcccaactctccatgcaggacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaatgaaaa

SEQ ID NO: 146072 - DNA, 2337 bp, Homo sapiens
  Payload ID: 8969
  Gene Symbol: KIF1BP
  Gene Name: KIF1 binding protein
  ENST ID: ENST00000626493
  CDS Start-End: 28-921
gaggaaagccaggcagtagaggccgctatggcgaacgttccgtgggcagaggtctgcgagaaattccaggcggcgctcgctctgtcgcgggtggaactgcataaaaatccggagaaggaaccatacaagtccaaatacagcgcccgggcgctactggaagaggtcaaggcgctgctcggccctgcgcctgaggacgaggatgagcggcctgaggccgaggacggcccgggtgccggtgaccacgccctggggctgccggctgaggtggtggagcccgaggggcccgtcgcccagcgagcggtgaggctggcagtcatcgagttccacctcggggtgaaccacatcgacacggaggagctgtcggcgggggaggagcacctggtgaaatgcctgcggctgctgcgcaggtaccggctctcgcacgactgcatctctctctgcatccaggcgcagaataacctgggtatcttgtggtctgaaagagaagaaattgaaactgcacaggcttacctagagtcatcagaagcactatataatcagtatatgaaagaggttgggagtcctcctcttgatcctactgagcgttttcttcctgaagaagagaaacttactgaacaagagagatcaaaaagatttgaaaaggtttatactcataacctatattacctagctcaagtctaccagcatctggaaatgtttgagaaggctgctcactattgccatagtacactaaaacgccagcttgagcacaatgcctaccatcctatagagtgggctatcaatgctgctaccttgtcacagttttacatcaataagctatgctttatggaggccaggcactgtttatcagctgctaatgtcatttttggtcaaactggaaagatctcagccacagaagacagacaacataggagagcttgatcttgataaacagtctgaacttagagctttaaggaaaaaagaactagatgaggaggaaagcattcggaaaaaagctgtgcagtttggaaccggtgaactgtgtgatgccatctctgcagtagaagagaaagtgagctacttgagacctttagattttgaagaagccagagaacttttcttattgggtcagcactatgtctttgaggcaaaagagttctttcagattgatggttatgtcactgaccatattgaagttgtccaagaccacagtgctctgtttaaggtgcttgcattctttgaaactgacatggagagacggtgcaagatgcataaacgcagaatagccatgctagagcccctaactgtagacctgaatccacagtattatctgttggtcaacagacagatccagtttgaaattgcacatgcttactatgatatgatggatttgaaggttgccattgctgacaggctaagggatcctgattcacacattgtaaaaaaaataaataatcttaataagtcagcactgaagtactaccagctcttcttagactccctgagagacccaaataaagtattccctgagcatataggggaagatgttcttcgccctgccatgttagctaagtttcgagttgcccgtctctatggcaaaatcattactgcagatcccaagaaagagctggaaaatttggcaacatcattggaacattacaaatttattgttgattactgtgaaaagcatcctgaggccgcccaggaaatagaagttgagctagaacttagtaaagagatggttagtcttctcccaacaaaaatggagagattcagaaccaagatggccctgacttaatccttgtttttaaagaaaggaaatgtgcaatattgaagtgatctttttccctagtcagacaggcccaattccattgtgatgtttacctttatagccaggtgagtgcagtttgaacttgagatacagtcaactgagtgtttgctaggatcctaaggaacataaagttaattaaaaacttacacctaattatgtaaattgccttgttaaagacatgtgatttgtattttagatgcttgtttcctattaaaatacagacatttctaccctcagtttctaaatgtagactatttgttggctagtacttgatagattccttgtaagaaaaaatgctgggtaatgtacctggtaacaagcctgttaatatattaagattgaaaaagtaacttctatagttactccttctaaaatatttgacttcctaaattccccccacccaaaatctttcccttttgaaaatactaaaaactaagttatgttattataaagtgtaaaatggtttgtcttaattataggagaaaaaggccttgttagaaataaaataaactgacttatttcactaa

SEQ ID NO: 146073 - DNA, 1800 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000326542
  CDS Start-End: 15-1298
gcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146074 - DNA, 1564 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000358178
  CDS Start-End: 12-1061
ccggcagcaccatgtcgctcatggtcgtcagcatggcgtgtgttgggttgttcttggtccagagggccggtccacacatgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146075 - DNA, 1871 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000391728
  CDS Start-End: 34-1368
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146076 - DNA, 1663 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000402254
  CDS Start-End: 34-1401
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 146077 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000622691
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggagcggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146078 - DNA, 1852 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619247
  CDS Start-End: 1-1368
atgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146079 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000612391
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146080 - DNA, 1497 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620643
  CDS Start-End: 26-1393
gctgcctgtctgcaccggcagcaccatgtcgctcatggtcgtcagcatggcgtgtgttgggttcttcttgctgcagggggcctggccacatgagggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcaca

SEQ ID NO: 146081 - DNA, 1865 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000621718
  CDS Start-End: 28-1362
cggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacgttctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatatgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgagtaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146082 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000621071
  CDS Start-End: 34-1368
ggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcaagcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctact

SEQ ID NO: 146083 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000615312
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146084 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619271
  CDS Start-End: 25-1308
ccgcctgtctgcaccggcagcaccatgttgctcatggtcgtcagcatggcgtgtgttgggttcttcttggtccagagggccggtccacacatgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcagaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146085 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620450
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146086 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619211
  CDS Start-End: 34-1368
ggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctact

SEQ ID NO: 146087 - DNA, 1852 bp, Homo sapiens; identical to SEQ ID NO: 146078
  Payload ID: 8970
  Gene Symbol: KIR3DL1
  Gene Name: killer cell immunoglobulin-like receptor, three domains, long cytoplasmic tail, 1
  ENST ID: ENST00000617464
  CDS Start-End: 1-1368

SEQ ID NO: 146088 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620343
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146089 - DNA, 1865 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619476
  CDS Start-End: 28-1362
cagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146090 - DNA, 1865 bp, Homo sapiens; identical to SEQ ID NO: 146089
  Payload ID: 8970
  Gene Symbol: KIR3DL1
  Gene Name: killer cell immunoglobulin-like receptor, three domains, long cytoplasmic tail, 1
  ENST ID: ENST00000622515
  CDS Start-End: 28-1362

SEQ ID NO: 146091 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000621398
  CDS Start-End: 34-1368
ggggcgcggccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctact

SEQ ID NO: 146092 - DNA, 1863 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000613869
  CDS Start-End: 26-1360
gccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacatcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146093 - DNA, 1900 bp, Homo sapiens; identical to SEQ ID NO: 146088
  Payload ID: 8970
  Gene Symbol: KIR3DL1
  Gene Name: killer cell immunoglobulin-like receptor, three domains, long cytoplasmic tail, 1
  ENST ID: ENST00000618560
  CDS Start-End: 64-1398

SEQ ID NO: 146094 - DNA, 1811 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620834
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcaagcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146095 - DNA, 1663 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620750
  CDS Start-End: 34-1401
ggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 146096 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000622825
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacatgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcagaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146097 - DNA, 1663 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000611181
  CDS Start-End: 34-1401
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 146098 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620062
  CDS Start-End: 34-1368
ggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcatcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctact

SEQ ID NO: 146099 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000621759
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacgttctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatatgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgagtaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146100 - DNA, 1497 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620703
  CDS Start-End: 26-1393
gccgcctgtctgcaccggcagcaccatgtcgctcatggtcgtcagcatggcgtgtgttgggttcttcttgctgcagggggcctggccacatgagggtggtcaggacaaacccttcctgtctgcctggcccagcgctgtggtgcctcgaggaggacacgtgactcttcggtgtcactatcatcataggtttaacaatttcatgctatacaaagaagacggaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcatgttctcattgggacctcagtggtcatcatcctcttcatcctcctcctcttctttctccttcatctctggtactccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcaca

SEQ ID NO: 146101 - DNA, 1663 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000615752
  CDS Start-End: 34-1401
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 146102 - DNA, 1860 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000610602
  CDS Start-End: 64-1398
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttc

SEQ ID NO: 146103 - DNA, 1810 bp, Homo sapiens; identical to SEQ ID NO: 146085
  Payload ID: 8970
  Gene Symbol: KIR3DL1
  Gene Name: killer cell immunoglobulin-like receptor, three domains, long cytoplasmic tail, 1
  ENST ID: ENST00000611567
  CDS Start-End: 25-1308

SEQ ID NO: 146104 - DNA, 1663 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000614238
  CDS Start-End: 34-1401
ggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcatcataggtttaacaatttcatgctatacaaagaagacggaatccacattcccatcttccatggcagaatattccaggagagcttcaacatgagccctgtgaccacagcacatgcagggaactacacatgtcggggttcacacccacactcccccactgggtggttggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctact

SEQ ID NO: 146105 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619277
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146106 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000615523
  CDS Start-End: 64-1398
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146107 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000616835
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacatcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146108 - DNA, 1863 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000612415
  CDS Start-End: 26-1360
gccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146109 - DNA, 1849 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000611574
  CDS Start-End: 64-1347
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146110 - DNA, 1860 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000610345
  CDS Start-End: 64-1398
ataacatcctgtgcgctgctgagctgagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttc

SEQ ID NO: 146111 - DNA, 1858 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000612933
  CDS Start-End: 64-1398
ataacatcctgtgcgctgctgagctgagctggggcgcggccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcatcataggtttaacaatttcatgctatacaaagaagacggaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcatgttctcattgggacctcagtggtcatcatcctcttcatcctcctcctcttctttctccttcatctctggtactccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcctgagtcttcatcttagggcatcgctcctcctcacgccacaaatctggcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttc

SEQ ID NO: 146112 - DNA, 1900 bp, Homo sapiens; identical to SEQ ID NO: 146088
  Payload ID: 8970
  Gene Symbol: KIR3DL1
  Gene Name: killer cell immunoglobulin-like receptor, three domains, long cytoplasmic tail, 1
  ENST ID: ENST00000619411
  CDS Start-End: 64-1398

SEQ ID NO: 146113 - DNA, 1658 bp, Homo sapiens; identical to SEQ ID NO: 146091
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000616945
  CDS Start-End: 34-1368

SEQ ID NO: 146114 - DNA, 1810 bp, Homo sapiens; identical to SEQ ID NO: 146099
  Payload ID: 8970
  Gene Symbol: KIR3DL1
  Gene Name: killer cell immunoglobulin-like receptor, three domains, long cytoplasmic tail, 1
  ENST ID: ENST00000614221
  CDS Start-End: 25-1308

SEQ ID NO: 146115 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000616424
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattcaaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146116 - DNA, 1860 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000613229
  CDS Start-End: 64-1398
ataacatcctgtgcgctgctgagctgagctggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcatcataggtttaacaatttcatgctatacaaagaagacggaatccacattcccatcttccatggcagaatattccaggagagcttcaacatgagccctgtgaccacagcacatgcagggaactacacatgtcggggttcacacccacactcccccactgggtggttggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcatgttctcattgggacctcagtggtcatcatcctcttcatcctcctcctcttctttctccttcatctctggtactccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcctgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttc

SEQ ID NO: 146117 - DNA, 1852 bp, Homo sapiens; identical to SEQ ID NO: 146078
  Payload ID: 8970
  Gene Symbol: KIR3DL1
  Gene Name: killer cell immunoglobulin-like receptor, three domains, long cytoplasmic tail, 1
  ENST ID: ENST00000618016
  CDS Start-End: 1-1368

SEQ ID NO: 146118 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000613816
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacgttctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatatgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgagtaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146119 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620579
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcaagcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146120 - DNA, 1865 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000620568
  CDS Start-End: 28-1362
cggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146121 - DNA, 1453 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000611230
  CDS Start-End: 12-1061
ccggcagcaccatgttgctcatggtcgtcagcatggcgtgtgttgggttcttcttggtccagagggccggtccacacgtgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctg

SEQ ID NO: 146122 - DNA, 1852 bp, Homo sapiens; identical to SEQ ID NO: 146078
  Payload ID: 8970
  Gene Symbol: KIR3DL1
  Gene Name: killer cell immunoglobulin-like receptor, three domains, long cytoplasmic tail, 1
  ENST ID: ENST00000614736
  CDS Start-End: 1-1368

SEQ ID NO: 146123 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000618436
  CDS Start-End: 25-1308
ccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcgatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146124 - DNA, 1810 bp, Homo sapiens; identical to SEQ ID NO: 146123
  Payload ID: 8970
  Gene Symbol: KIR3DL1
  Gene Name: killer cell immunoglobulin-like receptor, three domains, long cytoplasmic tail, 1
  ENST ID: ENST00000620836
  CDS Start-End: 25-1308

SEQ ID NO: 146125 - DNA, 1466 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619931
  CDS Start-End: 25-1074
ccgcctgtctgcaccggcagcaccatgttgctcatggtcgtcagcatggcgtgtgttgggttcttcttggtccagagggccggtccacacgtgggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcaagcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctg

SEQ ID NO: 146126 - DNA, 1865 bp, Homo sapiens; identical to SEQ ID NO: 146081
  Payload ID: 8970
  Gene Symbol: KIR3DL1
  Gene Name: killer cell immunoglobulin-like receptor, three domains, long cytoplasmic tail, 1
  ENST ID: ENST00000611451
  CDS Start-End: 28-1362

SEQ ID NO: 146127 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000615258
  CDS Start-End: 39-1373
gagctggggcgcggccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcatcataggtttaacaatttcatgctatacaaagaagacggaatccacattcccatcttccatggcagaatattccaggagagcttcaacatgagccctgtgaccacagcacatgcagggaactacacatgtcggggttcacacccacactcccccactgggtggttggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcatgttctcattgggacctcagtggtcatcatcctcttcatcctcctcctcttctttctccttcatctctggtactccaacaaaaaaaatgctgctgtaatggaccaagagcctgcagggaacagaacagccaacagcgaggactctgatgaacaagaccctcaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcctgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagt

SEQ ID NO: 146128 - DNA, 1658 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000611993
  CDS Start-End: 39-1373
gagctggggcgcggccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacacctcctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgctttggctctttccgtcactctccctacgagttgtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgagggcgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagt

SEQ ID NO: 146129 - DNA, 1875 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000614720
  CDS Start-End: 39-1373
gagctggggcgcggccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggagcggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146130 - DNA, 1860 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000616188
  CDS Start-End: 64-1398
ataacatcctgtgcgctgctgagctgagctggggcgcagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttc

SEQ ID NO: 146131 - DNA, 1852 bp, Homo sapiens; identical to SEQ ID NO: 146078
  Payload ID: 8970
  Gene Symbol: KIR3DL1
  Gene Name: killer cell immunoglobulin-like receptor, three domains, long cytoplasmic tail, 1
  ENST ID: ENST00000615693
  CDS Start-End: 1-1368

SEQ ID NO: 146132 - DNA, 1497 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000622067
  CDS Start-End: 26-1393
gccgcctgtctgcacagacagcaccatgtcgctcatggtcgtcagcatggcgtgtgttgggttcttcttgctgcagggggcctggccacatgagggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacgttctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctcaggaggtgacatatgcacagttggatcactgcgttttcacacagagaaaaatcactcgcccttctcagaggcccaagacaccccctacagataccatcttgtacacggaacttccaaatgctaagcccagatccaaagttgtctcctgcccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcaca

SEQ ID NO: 146133 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000615036
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacatcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146134 - DNA, 1865 bp, Homo sapiens; identical to SEQ ID NO: 146089
  Payload ID: 8970
  Gene Symbol: KIR3DL1
  Gene Name: killer cell immunoglobulin-like receptor, three domains, long cytoplasmic tail, 1
  ENST ID: ENST00000620959
  CDS Start-End: 28-1362

SEQ ID NO: 146135 - DNA, 1810 bp, Homo sapiens; identical to SEQ ID NO: 146085
  Payload ID: 8970
  Gene Symbol: KIR3DL1
  Gene Name: killer cell immunoglobulin-like receptor, three domains, long cytoplasmic tail, 1
  ENST ID: ENST00000610515
  CDS Start-End: 25-1308

SEQ ID NO: 146136 - DNA, 1810 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000614464
  CDS Start-End: 25-1308
ccgcctgtctgcaccggcagcaccatgttgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcatcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146137 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000619018
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcatcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146138 - DNA, 1865 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000612668
  CDS Start-End: 28-1362
cagccgcctgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146139 - DNA, 1863 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000617680
  CDS Start-End: 26-1360
gccgcctgtctgcaccggcagcaccatgttgctcatggtcgtcagcatggcgtgtgttgggttcttcttggtccagagggccggtccacacatgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcagaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146140 - DNA, 1852 bp, Homo sapiens; identical to SEQ ID NO: 146078
  Payload ID: 8970
  Gene Symbol: KIR3DL1
  Gene Name: killer cell immunoglobulin-like receptor, three domains, long cytoplasmic tail, 1
  ENST ID: ENST00000612513
  CDS Start-End: 1-1368

SEQ ID NO: 146141 - DNA, 1857 bp, Homo sapiens
  Payload ID: 8970
  Gene Symbol: KIR3DL1
  Gene Name: killer cell immunoglobulin-like receptor, three domains, long cytoplasmic tail, 1
  Uniprot ID: P43629
  ENST ID: ENST00000621353
  CDS Start-End: 20-1354
tgtctgcaccggcagcaccatgtcgctcatggtcgtcagcatggcgtgtgttgggttgttcttggtccagagggccggtccacacatgggtggtcaggacaaacccttcctgtctgcctggcccagcgctgtggtgcctcgaggaggacacgtgactcttcggtgtcactatcgtcataggtttaacaatttcatgctatacaaagaagacagaatccacattcccatcttccatggcagaatattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctca

SEQ ID NO: 146142 - DNA, 1900 bp, Homo sapiens
  Payload ID: 8970
  Gene Symbol: KIR3DL1
  Gene Name: killer cell immunoglobulin-like receptor, three domains, long cytoplasmic tail, 1
  ENST ID: ENST00000617665
  CDS Start-End: 64-1398
ataacatcctgtgcgctgctgagctgagctggggcgcggccgcctgtctgcaccggcagcaccatgtcgctcatggtcgtcagcatggcgtgtgttgggttcttcttggtccagagggccggtccacacgtgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagattattccaggagagcttcaacatgagccctgtgaccacagcacatgcagggaactacacatgtcggggttcacacccacactcccccactgggtggtcggcacccagcaaccccgtggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggtcccatgatgcttgcccttgcagggacctacagatgctacggttctgttactcacaccccctatcagttgtcagctcccagtgatcccctggacatcgtggtcacaggtccatatgagaaaccttctctctcagcccagccgggccccaaggttcaggcaggagagagcgtgaccttgtcctgcagctcccggagctcctatgacatgtaccatctatccagggagcggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaaccccagacacctgcacattctgattgggacctcagtggtcatcatcctcttcatcctcctcctcttctttctccttcatctctggtgctccaacaaaaaaaatgctgctgtaatggaccaagagcctgcagggaacagaacagccaacagcgaggactctgatgaacaagaccctgaggaggtgacatacgcacagttggatcactgcgttttcacacagagaaaaatcactcgcccttctcagaggcccaagacaccccctacagataccatcttgtacacggaacttccaaatgctaagcccagatccaaagttgtctcctgcccatgagcaccacagtcaggccttgaggacgtcttctagggagacaacagccctgtctcaaaaccgagttgccagctcccatgtaccagcagctggaatctgaaggcgtgagtcttcatcttagggcatcgctcctcctcacgccacaaatctggtgcctctctcttgcttacaaatgtctaggtccccactgcctgctggaaagaaaacacactcctttgcttagcccacagttctccatttcacttgacccctgcccacctctccaacctaactggcttacttcctagtctacttgaggctgcaatcacactgaggaactcacaattccaaacatacaagaggctccctcttgacgtggcacttacccacgtgctgttccaccttccctcatgctgtttcacctttcttcggactattttccagccttctgtcagcagtgaaacttataaaattttttgtgatttcaatgtagctgtctcctcttcaaataaacatgtctgccctc

SEQ ID NO: 146143 - DNA, 1546 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000270442
  CDS Start-End: 1-1317
atgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctc

SEQ ID NO: 146144 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000326321
  CDS Start-End: 34-1401
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146145 - DNA, 1597 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000622453
  CDS Start-End: 1-1368
atgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctc

SEQ ID NO: 146146 - DNA, 1863 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000621155
  CDS Start-End: 20-1387
tgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146147 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000616854
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcctggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146148 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000622249
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146149 - DNA, 1915 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000618237
  CDS Start-End: 64-1431
ataacatcctgtgcgctgctgagctgagctggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccaggggaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146150 - DNA, 1497 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000621841
  CDS Start-End: 26-1393
gccgcctgtctgcaccggcagcaccatgtcgctcacggtcgtcagcatggcgtgtgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccaggggaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcaca

SEQ ID NO: 146151 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000612733
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146152 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000613586
  CDS Start-End: 34-1350
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146153 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000617398
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatatcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146154 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615608
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146155 - DNA, 1546 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000622784
  CDS Start-End: 1-1317
atgtcgctcactgtcgtcagcatggcgtgcgttgggttcttcttgctgcagggggcctggccactcatgggtggtcaggacaaacccttcctgtctgcccggcccagcactgtggtgcctcgaggaggacatgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcatttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccatgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctc

SEQ ID NO: 146156 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000619683
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146157 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615308
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacacctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146158 - DNA, 1834 bp, Homo sapiens; identical to SEQ ID NO: 146154
  Payload ID: 8971
  Gene Symbol: KIR3DL2
  Gene Name: killer cell immunoglobulin-like receptor, three domains, long cytoplasmic tail, 2
  ENST ID: ENST00000618475
  CDS Start-End: 34-1350

SEQ ID NO: 146159 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615712
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146160 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615208
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgacctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146161 - DNA, 1874 bp, Homo sapiens; identical to SEQ ID NO: 146156
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000614753
  CDS Start-End: 31-1398

SEQ ID NO: 146162 - DNA, 1546 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000610507
  CDS Start-End: 1-1317
atgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccgtggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacacctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctc

SEQ ID NO: 146163 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000622024
  CDS Start-End: 34-1401
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccgtggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacacctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146164 - DNA, 1834 bp, Homo sapiens; identical to SEQ ID NO: 146154
  Payload ID: 8971
  Gene Symbol: KIR3DL2
  Gene Name: killer cell immunoglobulin-like receptor, three domains, long cytoplasmic tail, 2
  ENST ID: ENST00000612018
  CDS Start-End: 34-1350

SEQ ID NO: 146165 - DNA, 1834 bp, Homo sapiens; identical to SEQ ID NO: 146151
  Payload ID: 8971
  Gene Symbol: KIR3DL2
  Gene Name: killer cell immunoglobulin-like receptor, three domains, long cytoplasmic tail, 2
  ENST ID: ENST00000613029
  CDS Start-End: 34-1350

SEQ ID NO: 146166 - DNA, 1863 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000620550
  CDS Start-End: 20-1387
tgtctgcaccggcagcaccatgtcgctcactgtcgtcagcatggcgtgcgttgggttcttcttgctgcagggggcctggccactcatgggtggtcaggacaaacccttcctgtctgcctggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146167 - DNA, 1885 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000620817
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146168 - DNA, 1834 bp, Homo sapiens; identical to SEQ ID NO: 146151
  Payload ID: 8971
  Gene Symbol: KIR3DL2
  Gene Name: killer cell immunoglobulin-like receptor, three domains, long cytoplasmic tail, 2
  ENST ID: ENST00000616626
  CDS Start-End: 34-1350

SEQ ID NO: 146169 - DNA, 1863 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000611608
  CDS Start-End: 20-1387
tgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146170 - DNA, 1834 bp, Homo sapiens; identical to SEQ ID NO: 146151
  Payload ID: 8971
  Gene Symbol: KIR3DL2
  Gene Name: killer cell immunoglobulin-like receptor, three domains, long cytoplasmic tail, 2
  ENST ID: ENST00000620280
  CDS Start-End: 34-1350

SEQ ID NO: 146171 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000611872
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccaggggaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146172 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000611859
  CDS Start-End: 34-1350
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146173 - DNA, 1834 bp, Homo sapiens; identical to SEQ ID NO: 146154
  Payload ID: 8971
  Gene Symbol: KIR3DL2
  Gene Name: killer cell immunoglobulin-like receptor, three domains, long cytoplasmic tail, 2
  ENST ID: ENST00000622574
  CDS Start-End: 34-1350

SEQ ID NO: 146174 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000610914
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatatcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146175 - DNA, 1662 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000610587
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctac

SEQ ID NO: 146176 - DNA, 398 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000617195
  CDS Start-End: 44-398
gagctgagctggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacag

SEQ ID NO: 146177 - DNA, 666 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000612483
  CDS Start-End: 1-666
atgtcgctcactgtcgtcagcatggcgtgcgttgggttcttcttgctgcagggggcctggccactcatgggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggt

SEQ ID NO: 146178 - DNA, 1662 bp, Homo sapiens; identical to SEQ ID NO: 146175
  Payload ID: 8971
  Gene Symbol: KIR3DL2
  Gene Name: killer cell immunoglobulin-like receptor, three domains, long cytoplasmic tail, 2
  ENST ID: ENST00000613891
  CDS Start-End: 34-1401

SEQ ID NO: 146179 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000617666
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146180 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000617481
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146181 - DNA, 1834 bp, Homo sapiens; identical to SEQ ID NO: 146151
  Payload ID: 8971
  Gene Symbol: KIR3DL2
  Gene Name: killer cell immunoglobulin-like receptor, three domains, long cytoplasmic tail, 2
  ENST ID: ENST00000616505
  CDS Start-End: 34-1350

SEQ ID NO: 146182 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000617957
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146183 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000611628
  CDS Start-End: 31-1398
gcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146184 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000617684
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgacctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146185 - DNA, 1834 bp, Homo sapiens; identical to SEQ ID NO: 146154
  Payload ID: 8971
  Gene Symbol: KIR3DL2
  Gene Name: killer cell immunoglobulin-like receptor, three domains, long cytoplasmic tail, 2
  ENST ID: ENST00000612166
  CDS Start-End: 34-1350

SEQ ID NO: 146186 - DNA, 1834 bp, Homo sapiens; identical to SEQ ID NO: 146180
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000618273
  CDS Start-End: 34-1350

SEQ ID NO: 146187 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000621701
  CDS Start-End: 31-1398
gcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcatttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccatgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146188 - DNA, 1662 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000617354
  CDS Start-End: 34-1401
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctac

SEQ ID NO: 146189 - DNA, 1863 bp, Homo sapiens; identical to SEQ ID NO: 146146
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000613610
  CDS Start-End: 20-1387

SEQ ID NO: 146190 - DNA, 1670 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000613612
  CDS Start-End: 13-1380
accggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagatgggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactca

SEQ ID NO: 146191 - DNA, 1834 bp, Homo sapiens; identical to SEQ ID NO: 146172
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000612138
  CDS Start-End: 34-1350

SEQ ID NO: 146192 - DNA, 1546 bp, Homo sapiens
  Payload ID: 8971
  Gene Symbol: KIR3DL2
  Gene Name: killer cell immunoglobulin-like receptor, three domains, long cytoplasmic tail, 2
  Uniprot ID: P43630
  ENST ID: ENST00000622579
  CDS Start-End: 1-1317
atgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctc

SEQ ID NO: 146193 - DNA, 1033 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000620501
  CDS Start-End: 34-1033
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctg

SEQ ID NO: 146194 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000613109
  CDS Start-End: 34-1350
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacacctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146195 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000620485
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146196 - DNA, 1546 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000616961
  CDS Start-End: 1-1317
atgtcgctcactgtcgtcagcatggcgtgcgttgggttcttcttgctgcagggggcctggccactcatgggtggtcaggacaaacccttcctgtctgcccggcccagcactgtggtgcctcaaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggaccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccccaacagataccagcgtgtacacggaacttccaaatgctgagcccagatccaaagttgtctcctgcccacgagcaccacagtcaggtcttgagggggttttctagggagacaacagccctgtctcaaaaccaggttgccagctcccatgaaccagcagctggaatctgaaggcgtcagtcttcatcttagggcattgctcttcctcacaccactaatctgaacatgcctctctcttgcttacaaatgtctaaggtccccactgcctgctggagagaaaacacactcctttgcttagcccacaattctccatttcacttgacccctgcccacctc

SEQ ID NO: 146197 - DNA, 1864 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000610296
  CDS Start-End: 13-1380
accggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcgacacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146198 - DNA, 1874 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615147
  CDS Start-End: 31-1398
gcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcaaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggaccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccccaacagataccagcgtgtacacggaacttccaaatgctgagcccagatccaaagttgtctcctgcccacgagcaccacagtcaggtcttgagggggttttctagggagacaacagccctgtctcaaaaccaggttgccagctcccatgaaccagcagctggaatctgaaggcgtcagtcttcatcttagggcattgctcttcctcacaccactaatctgaacatgcctctctcttgcttacaaatgtctaaggtccccactgcctgctggagagaaaacacactcctttgcttagcccacaattctccatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgccatcagtaaaatttataaattttttttataactttagtgtagctctctcctcttcaaataaacatgtctcccctca

SEQ ID NO: 146199 - DNA, 1063 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000612634
  CDS Start-End: 64-1063
ataacatcctgtgcgctgctgagctgagctggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctg

SEQ ID NO: 146200 - DNA, 1834 bp, Homo sapiens; identical to SEQ ID NO: 146151
  Payload ID: 8971
  Gene Symbol: KIR3DL2
  Gene Name: killer cell immunoglobulin-like receptor, three domains, long cytoplasmic tail, 2
  ENST ID: ENST00000619026
  CDS Start-End: 34-1350

SEQ ID NO: 146201 - DNA, 1834 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000615318
  CDS Start-End: 34-1350
ggggcgcggcctcctgtctgcaccggcagcaccatgtcgctcacggtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcatttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccatgccctgccctgcgtgtggtcaaactcaagtgacccactgcttgtttctgtcacaggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctcatggtttcg

SEQ ID NO: 146202 - DNA, 1863 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000618616
  CDS Start-End: 20-1387
tgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacacgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcacttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccgtgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgatgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatgcaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146203 - DNA, 1877 bp, Homo sapiens
  Payload ID: 8971
  Gene Symbol: KIR3DL2
  Gene Name: killer cell immunoglobulin-like receptor, three domains, long cytoplasmic tail, 2
  ENST ID: ENST00000616438
  CDS Start-End: 34-1401
ggggcgcggcctcctgtctgcaccggcagcaccatgtcgctcactgtcgtcagcatggcgtgcgttgggttcttcttgctgcagggggcctggccactcatgggtggtcaggacaaacccttcctgtctgcccggcccagcactgtggtgcctcgaggaggacatgtggctcttcagtgtcactatcgtcgtgggtttaacaatttcatgctgtacaaagaagacagaagccacgttcccatcttccacggcagaatattccaggagagcttcatcatgggccctgtgaccccagcacatgcagggacctacagatgtcggggttcacgcccacactccctcactgggtggtcggcacccagcaaccccctggtgatcatggtcacaggaaaccacagaaaaccttccctcctggcccacccagggcccctgctgaaatcaggagagacagtcatcctgcaatgttggtcagatgtcatgtttgagcatttctttctgcacagagaggggatctctgaggacccctcacgcctcgttggacagatccatgatggggtctccaaggccaacttctccatcggtcccttgatgcctgtccttgcaggaacctacagatgttatggttctgttcctcactccccctatcagttgtcagctcccagtgaccccctggacatcgtgatcacaggtctatatgagaaaccttctctctcagcccagccgggccccacggttcaggcaggagagaacgtgaccttgtcctgtagctcctggagctcctatgacatctaccatctgtccagggaaggggaggcccatgaacgtaggctccgtgcagtgcccaaggtcaacagaacattccaggcagactttcctctgggccctgccacccacggagggacctacagatgcttcggctctttccatgccctgccctgcgtgtggtcaaactcaagtgacccactgcttgtttctgtcacaggaaacccttcaagtagttggccttcacccacagaaccaagctccaaatctggtatctgcagacacctgcatgttctgattgggacctcagtggtcatcttcctcttcatcctcctcctcttctttctcctttatcgctggtgctccaacaaaaagaatgctgctgtaatggaccaagagcctgcgggggacagaacagtgaataggcaggactctgatgaacaagaccctcaggaggtgacgtacgcacagttggatcactgcgttttcatacagagaaaaatcagtcgcccttctcagaggcccaagacacccctaacagataccagcgtgtacacggaacttccaaatgctgagcccagatccaaagttgtctcctgcccacgagcaccacagtcaggtcttgagggggttttctagggagacaacagccctgtctcaaaaccaggttgccagatccaatgaaccagcagctggaatctgaaggcatcagtctgcatcttaggggatcgctcttcctcacaccacgaatctgaacatgcctctctcttgcttacaaatgcctaaggtcgccactgcctgctgcagagaaaacacactcctttgcttagcccacaagtatctatttcacttgacccctgcccacctctccaacctaactggcttacttcctagtcctacttgaggctgcaatcacactgaggaactcacaattccaaacatacaagaggctccctcttaacacggcacttacacacttgctgttccaccttccctcatgctgttccacctcccctcagactatctttcagccttctgtcatcagtaaaatttataaattttttttataacttcagtgtagctctctcctcttcaaataaacatgtctgccctca

SEQ ID NO: 146204 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000291860
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146205 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000615880
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146206 - DNA, 1694 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000611367
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctca

SEQ ID NO: 146207 - DNA, 1694 bp, Homo sapiens; identical to SEQ ID NO: 146206
  Payload ID: 8972
  Gene Symbol: KIR3DL3
  Gene Name: killer cell immunoglobulin-like receptor, three domains, long cytoplasmic tail, 3
  ENST ID: ENST00000620258
  CDS Start-End: 19-1251

SEQ ID NO: 146208 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  Uniprot ID: Q8N743
  ENST ID: ENST00000614568
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146209 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000620803
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcacttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146210 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000615690
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaggagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146211 - DNA, 1823 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000617919
  CDS Start-End: 31-1263
gcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctcatgttgttccacctttcctcagagtatctttcagccttctgtcagcagtaaaacttataaattttttttataatttcaatgtagttttctattcttcaagtaaacatgtctgccctca

SEQ ID NO: 146212 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000613666
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146213 - DNA, 1233 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000614210
  CDS Start-End: 1-1233
atgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcagttttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcagctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggacctacagatgcttcggctctttccgtgccctgccccacgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaa

SEQ ID NO: 146214 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000614190
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcatcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146215 - DNA, 1314 bp, Homo sapiens; identical to SEQ ID NO: 146212
  Payload ID: 8972
  Gene Symbol: KIR3DL3
  Gene Name: killer cell immunoglobulin-like receptor, three domains, long cytoplasmic tail, 3
  ENST ID: ENST00000618394
  CDS Start-End: 51-1283

SEQ ID NO: 146216 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000618993
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattctggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146217 - DNA, 1694 bp, Homo sapiens; identical to SEQ ID NO: 146206
  Payload ID: 8972
  Gene Symbol: KIR3DL3
  Gene Name: killer cell immunoglobulin-like receptor, three domains, long cytoplasmic tail, 3
  ENST ID: ENST00000611573
  CDS Start-End: 19-1251

SEQ ID NO: 146218 - DNA, 1691 bp, Homo sapiens; identical to SEQ ID NO: 146205
  Payload ID: 8972
  Gene Symbol: KIR3DL3
  Gene Name: killer cell immunoglobulin-like receptor, three domains, long cytoplasmic tail, 3
  ENST ID: ENST00000612251
  CDS Start-End: 19-1251

SEQ ID NO: 146219 - DNA, 1238 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000617100
  CDS Start-End: 6-1238
gcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaa

SEQ ID NO: 146220 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000620235
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcagttttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcagctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggacctacagatgcttcggctctttccgtgccctgccccacgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146221 - DNA, 1815 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000618713
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcatcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctcatgttgttccacctttcctcagagtatctttcagccttctgtcagcagtaaaacttataaattttttttataatttcaatgtagttttctattcttcaagtaaacatgtctgccctcatggt

SEQ ID NO: 146222 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000610861
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcatcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcatgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146223 - DNA, 1694 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000612502
  CDS Start-End: 19-1251
gtctgcaccggcagcaccatgtcgctcatggtcgtcagcatggcgtgtgttgggttcttcttgctggaggggccctggccacatgtaggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcagttttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggacctacagatgcttcggctctttccgtgccctgccccacgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctca

SEQ ID NO: 146224 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000622043
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146225 - DNA, 1314 bp, Homo sapiens; identical to SEQ ID NO: 146212
  Payload ID: 8972
  Gene Symbol: KIR3DL3
  Gene Name: killer cell immunoglobulin-like receptor, three domains, long cytoplasmic tail, 3
  ENST ID: ENST00000619074
  CDS Start-End: 51-1283

SEQ ID NO: 146226 - DNA, 1691 bp, Homo sapiens; identical to SEQ ID NO: 146205
  Payload ID: 8972
  Gene Symbol: KIR3DL3
  Gene Name: killer cell immunoglobulin-like receptor, three domains, long cytoplasmic tail, 3
  ENST ID: ENST00000610869
  CDS Start-End: 19-1251

SEQ ID NO: 146227 - DNA, 1833 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000610437
  CDS Start-End: 20-1297
tgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggacctacagatgcttcggctctttccgtgccctgccccacgcgtggtcagacccgagtgacccactgcccgtttctgtcacaggaactgctatgattagcttcttattggtgtcttgtcttcctccaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcagagtatctttcagccttctgtcagcagtaaaacttataaattttttttataatttcaatgtagttttctcttcttcaagtaaacatgtctgccctca

SEQ ID NO: 146228 - DNA, 1494 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000612757
  CDS Start-End: 26-1390
gccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccagcaccacagtcaggccttgagggcgtcttctagggagacaacagccctgtctcaaaaccgggttgccagctcccatgtaccagcagctggaatctgaaggcatgagtctgcatcttagggcatcgctcttcctcaca

SEQ ID NO: 146229 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000614181
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146230 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  Uniprot ID: Q8N743
  ENST ID: ENST00000613010
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146231 - DNA, 1726 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000613313
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcggaggccggtgaacttaggctcactgcagtgctgagggtcaatggaacattccaggccaacttccctctgggccctgtgacccacggagggaactacagatgcttcggctctttccgtgccctgccccatgcgtggtcagacccgagtgacccactgcccgtttctgtcacaggtaactccagatacctgcacgctctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccaccagcaccacagtcaggccttgatgggatcttctagggagacaatagccctgtctcaaaaccgggttgccagctcccatgtaccagcagctggaatctgaaggcgtgagtctgcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcgatcacactgaggaactcacaattccaaacatataagaggctccctcttaacacggcacttagatacatgctattccacctttcctca

SEQ ID NO: 146232 - DNA, 1314 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000611663
  CDS Start-End: 51-1283
tgctgctgaactgagctggggcgcagccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattctggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcattggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagaaacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatcc

SEQ ID NO: 146233 - DNA, 1694 bp, Homo sapiens; identical to SEQ ID NO: 146206
  Payload ID: 8972
  Gene Symbol: KIR3DL3
  Gene Name: killer cell immunoglobulin-like receptor, three domains, long cytoplasmic tail, 3
  ENST ID: ENST00000613587
  CDS Start-End: 19-1251

SEQ ID NO: 146234 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000620851
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggacctacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146235 - DNA, 1691 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000618920
  CDS Start-End: 19-1251
gtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcatcttgggtttaacgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccgggccccacggttcaggcaggagagaatgtgaccttgtcctgcagctcccggagcttgtttgacatttaccatctatccagggaggcagaggccggtgaacttaggctcactgcggtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146236 - DNA, 1691 bp, Homo sapiens; identical to SEQ ID NO: 146204
  Payload ID: 8972
  Gene Symbol: KIR3DL3
  Gene Name: killer cell immunoglobulin-like receptor, three domains, long cytoplasmic tail, 3
  ENST ID: ENST00000614255
  CDS Start-End: 19-1251

SEQ ID NO: 146237 - DNA, 1604 bp, Homo sapiens
  Payload ID: 8972
  Gene Symbol: KIR3DL3
  Gene Name: killer cell immunoglobulin-like receptor, three domains, long cytoplasmic tail, 3
  ENST ID: ENST00000617584
  CDS Start-End: 1-1164
ggtggtcaggacaagcccttcctctctgcctggcccggcactgtggtgtctgaaggacaacatgtgactcttcagtgtcgctctcgtcttgggtttaatgaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcaggagagacggtcatcctgcaatgttggtcagatgtcaggtttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcggctcccagtgaccctctggacatcgtggtcgtaggtctatatgggaaaccttctctctcagcccagccggaccccacggttcaggcaggagagaatgtgaccttgtcctgcagctctcggagcttgtttgacatttaccatctatccagggaggcagaggccggtgaacttaggctcactgcagtgctgagggtcaatggaacattccaggccaacttccctctgggccctgtgacccacggagggaactacagatgcttcggctctttccgtgccctgccccacgcgtggtcagacccgagtgacccactgcccgtttctgtcacaggtaactccagacacctgcacgttctgattgggacctcagtggtcatcatcccctttgctatcctcctcttctttctccttcatcgctggtgtgccaacaaaaagaatgctgttgtaatggaccaagagcctgcagggaacagaacagtgaacagggaggactctgatgaacaagaccctcaggaggtgacatacgcacagttgaatcactgcgttttcacacagagaaaaatcactcgcccttctcagaggcccaagacacccccaacagataccagcgtgtaacacggaacttccaaatgctgagcgcagatccaaagttgtcttctgtccactagcaccacagtcaggccttgatgggatcttctagggagacaatagccctgtctcaaaaccgggttgccagctcccatgtaccagcagctggactctgaaggcgtgagtctgcatcttagggcatcgctcttcctcacaccacgaatctgaacatgcctctctcttgcttacaaatgtctaaggtccccactgcctgctggagagaaaacacacttgcttagcccacaattctccatttcacttgacccctgcccacctctccaacctaactggcttacttcctagtctacttgaggctgcgatcacactgaggaactcacaattccaaacatataagaggctccctcttaacacggcacttagatacgtgctattccacctttcctcag

SEQ ID NO: 146238 - DNA, 1294 bp, Homo sapiens
  Payload ID: 8973
  Gene Symbol: KIR3DP1
  Gene Name: killer cell immunoglobulin-like receptor, three domains, pseudogene 1
  ENST ID: ENST00000614885
  CDS Start-End: 2-988
catgtcgctcatggtcgtcagcatggcgtgtgttgggttcttcttgctgcagggggcctggccacatgagggtggtcaggacaagcccttcctctctgcctggcccagccctgtggtgtctgaaggagaacatgtggctcttcagtgtcgctctcgtcttgggtttaacgaattcagtctgtccaaagaagacgggatgcctgtccctgagctctacaacagagtattccgaaacaccgttttcataggccctgtgaccccagcacatgcagggacctacagatgtcggggttcacacccacacttcctcactgggtggtcagcacccagcaaccccctggtgatcatggtcacaggagtccacagaaaaccttccctcctggcccacccaggtcccctggtgaaatcagaagagacagtcatcctgcaatgttggtcagatgtcatgtttgagcacttccttctgcacagagaggggaagtttaatgacactttgcgcctcactggagagctccatgatggggtctccaaggccaacttctccatcggtcgcatgacgcaagaccttgcagggacctacagatgctacggttctgttcctcattccccctatcagttgtcagctcccagtgaccctctggacatcgtgattacaggtctatgtgggaaaccttctctctcagcccagccgcgccccatggttaaggcaggagagagcgtgaccttgtcctgcagctcccggagctcctatgacatctaccatctatcaagggacggggaggctcatgaacttaggttccctgcagtgcccaaggtcaatggaaccttccaggccaactttcctctgggccctgccacccacggagggacctacagatgcttcggctctttccgtgactctccctacgagtggtcagaccttagtgacccactgcttgtttctgtcacagattctatgaaggagaaaggaaaagatgtgatactgtaattttgctccatttgtctaaaatgagtaggctgcaactcctcttgaagtgataccttttctagctcttgttggaggtgtctcaggactcattacttcggggaacctgcaactgtgtcagtctggggaaactgcaaatattcttgtcttacatttgtctccagccaattgtgatggactccagtgacctgcaattgctgttattgcaggtaaaatgtacctgagtcaggccacagttctcctggactatgagcccctggccatgttcctgaggcaattctgttcatctaaatataataataataacac

SEQ ID NO: 146239 - DNA, 1294 bp, Homo sapiens; identical to SEQ ID NO: 139185
  Payload ID: 8973
  Gene Symbol: KIR3DP1
  Gene Name: killer cell immunoglobulin-like receptor, three domains, pseudogene 1
  ENST ID: ENST00000621881
  CDS Start-End: 2-988

SEQ ID NO: 146240 - DNA, 978 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000611309
  CDS Start-End: 12-839
ccggcagcaccatgttgctcatggtcgtcagcatggcgtgtgttggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacataga

SEQ ID NO: 146241 - DNA, 1740 bp, Homo sapiens
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000616075
  CDS Start-End: 12-1175
ccggcagcaccatgtcgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 146242 - DNA, 1497 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000611562
  CDS Start-End: 26-1393
gccgcctgtctgcaccggcagcaccatgtcgctcatggtcgtcagcatggcgtgtgttgggttcttcttggaccagagtgtgtgggcacacgtgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacagagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcaaa

SEQ ID NO: 146243 - DNA, 1541 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000618890
  CDS Start-End: 38-1186
agctggggcgcagccgcctgtctgcaccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttac

SEQ ID NO: 146244 - DNA, 1740 bp, Homo sapiens; identical to SEQ ID NO: 146241
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000619911
  CDS Start-End: 12-1175

SEQ ID NO: 146245 - DNA, 1380 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000621178
  CDS Start-End: 64-1212
ataacatcctgtgcgctgctgagctgagctggggcgcagccgcctgtctgcaccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaag

SEQ ID NO: 146246 - DNA, 1769 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000615875
  CDS Start-End: 38-1204
agctggggcgcagccgcctgtctgcaccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 146247 - DNA, 1769 bp, Homo sapiens; identical to SEQ ID NO: 146246
  Payload ID: 8974
  Gene Symbol: KIR3DS1
  Gene Name: killer cell immunoglobulin-like receptor, three domains, short cytoplasmic tail, 1
  ENST ID: ENST00000622416
  CDS Start-End: 38-1204

SEQ ID NO: 146248 - DNA, 1740 bp, Homo sapiens; identical to SEQ ID NO: 146241
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000616388
  CDS Start-End: 12-1175

SEQ ID NO: 146249 - DNA, 1660 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000614429
  CDS Start-End: 34-1182
ggggcgcagccgcctgtctgcaccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctac

SEQ ID NO: 146250 - DNA, 931 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000620731
  CDS Start-End: 1-864
atgttgctcatggtcgtcagcatggcgtgtgttgggttgttcttggtccagagggccggtccacacatgggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgtttt

SEQ ID NO: 146251 - DNA, 1769 bp, Homo sapiens; identical to SEQ ID NO: 146246
  Payload ID: 8974
  Gene Symbol: KIR3DS1
  Gene Name: killer cell immunoglobulin-like receptor, three domains, short cytoplasmic tail, 1
  ENST ID: ENST00000620611
  CDS Start-End: 38-1204

SEQ ID NO: 146252 - DNA, 1656 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000614217
  CDS Start-End: 14-1162
caccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacagagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcac

SEQ ID NO: 146253 - DNA, 1740 bp, Homo sapiens; identical to SEQ ID NO: 146241
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000615275
  CDS Start-End: 12-1175

SEQ ID NO: 146254 - DNA, 1690 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000610716
  CDS Start-End: 64-1212
ataacatcctgtgcgctgctgagctgagctggggcgcagccgcctgtctgcaccggcagcaccatgttgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctac

SEQ ID NO: 146255 - DNA, 1541 bp, Homo sapiens; identical to SEQ ID NO: 146243
  Payload ID: 8974
  Gene Symbol: KIR3DS1
  Gene Name: killer cell immunoglobulin-like receptor, three domains, short cytoplasmic tail, 1
  ENST ID: ENST00000620498
  CDS Start-End: 38-1186

SEQ ID NO: 146256 - DNA, 1769 bp, Homo sapiens; identical to SEQ ID NO: 146246
  Payload ID: 8974
  Gene Symbol: KIR3DS1
  Gene Name: killer cell immunoglobulin-like receptor, three domains, short cytoplasmic tail, 1
  ENST ID: ENST00000621225
  CDS Start-End: 38-1204

SEQ ID NO: 146257 - DNA, 1740 bp, Homo sapiens; identical to SEQ ID NO: 146241
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000616583
  CDS Start-End: 12-1175

SEQ ID NO: 146258 - DNA, 1740 bp, Homo sapiens; identical to SEQ ID NO: 146241
  Payload ID: 8974
  Gene Symbol: KIR3DS1
  Gene Name: killer cell immunoglobulin-like receptor, three domains, short cytoplasmic tail, 1
  Uniprot ID: Q14943
  ENST ID: ENST00000613279
  CDS Start-End: 12-1175

SEQ ID NO: 146259 - DNA, 1740 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000617337
  CDS Start-End: 12-1175
ccggcagcaccatgtcgctcatggtcgtcagcatggcgtgtgttgggttgttcttggtccagagggccggtccacacatgggtggtcaggacaagcccttcctgtctgcctggcccagcgctgtggtgcctcgcggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacagagagtggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggtctatatgagaaaccttctctctcagcccagccgggccccaaggttcaggcaggagagagcgtgaccttgtcctgtagctcccggagctcctatgacatgtaccatctatccagggaggggggagcccatgaacgtaggctccctgcagtgcgcaaggtcaacagaacattccaggcagatttccctctgggccctgccacccacggagggacctacagatgcttcggctctttccgtcactctccctacgagtggtcagacccgagtgacccactgcttgtttctgtcacaggaaacccttcaagtagttggccttcacccacagaaccaagctccaaatctggtaacctcagacacctgcacattctgattgggacctcagtggtcaaaatccctttcaccatcctcctcttctttctccttcatcgctggtgctccaacaaaaaaaatgctgctgtaatggaccaagagcctgcagggaacagaagtgaacagcgaggattctgatgaacaagaccatcaggaggtgtcatacgcataattggaacactgtgttttcacacagagaaaaatcactcgcccttctcagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaactgggttgccagctcccatgtaccagcagctggaatctgaaggcatcagtcttcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctg

SEQ ID NO: 146260 - DNA, 1690 bp, Homo sapiens; identical to SEQ ID NO: 146254
  Payload ID: 8974
  Gene Symbol: KIR3DS1
  Gene Name: killer cell immunoglobulin-like receptor, three domains, short cytoplasmic tail, 1
  ENST ID: ENST00000620926
  CDS Start-End: 64-1212

SEQ ID NO: 146261 - DNA, 671 bp, Homo sapiens
  Payload ID: 8974
  Gene Symbol: KIR3DS1
  Gene Name: killer cell immunoglobulin-like receptor, three domains, short cytoplasmic tail, 1
  ENST ID: ENST00000612571
  CDS Start-End: 15-671
gcaccggcagcaccatgttgctcatggtcgtcagcatggcgtgtgttgggttcttcttggtccagagggccggtccacacatgggtggtcaggacaagcccttcctgtctgcctggcccagcgctgtggtgcctcgaggaggacacgtgactcttcggtgtcactatcgtcataggtttaacaatttcatgctatacaaagaagacagaatccacgttcccatcttccatggcagaatattccaggagggcttcaacatgagccctgtgaccacagcacatgcagggaactacacatgtcggggttcacacccacactcccccactgggtggtcggcacccagcaaccccatggtgatcatggtcacaggaaaccacagaaaaccttccctcctggcccacccaggtcccctggtgaaatcaggagagagagtcatcctgcaatgttggtcagatatcatgtttgagcacttctttctgcacaaagaggggatctctaaggacccctcacgcctcgttggacagatccatgatggggtctccaaggccaatttctccatcggttccatgatgcgtgcccttgcagggacctacagatgctacggttctgttactcacaccccctatcagttgtcagctcccagtgatcccctggacatcgtggtcacaggt

SEQ ID NO: 146262 - DNA, 1769 bp, Homo sapiens; identical to SEQ ID NO: 146246
  Payload ID: 8974
  Gene Symbol: KIR3DS1
  Gene Name: killer cell immunoglobulin-like receptor, three domains, short cytoplasmic tail, 1
  ENST ID: ENST00000610591
  CDS Start-End: 38-1204

SEQ ID NO: 146263 - DNA, 1378 bp, Homo sapiens
  Payload ID: 8975
  Gene Symbol: KIR3DX1
  Gene Name: killer cell immunoglobulin-like receptor, three domains, X1
  Uniprot ID: Q9H7L2
  ENST ID: ENST00000221567
  CDS Start-End: 8-1066
tggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcgatttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacg

SEQ ID NO: 146264 - DNA, 1240 bp, Homo sapiens
  Payload ID: 8975
  Gene Symbol: KIR3DX1
  Gene Name: killer cell immunoglobulin-like receptor, three domains, X1
  ENST ID: ENST00000447145
  CDS Start-End: 107-526
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcgatttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146265 - DNA, 1333 bp, Homo sapiens
  Payload ID: 8975
  Gene Symbol: KIR3DX1
  Gene Name: killer cell immunoglobulin-like receptor, three domains, X1
  ENST ID: ENST00000446586
  CDS Start-End: 107-508
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcgatttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatctgggggaggctggatcacgctgcagcctcaggcacgcccttgccttgttttggtcttggtattgccacctctgaagtgaagatctggaagactttctttttcaccccacagacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146266 - DNA, 1222 bp, Homo sapiens
  Payload ID: 8975
  Gene Symbol: KIR3DX1
  Gene Name: killer cell immunoglobulin-like receptor, three domains, X1
  ENST ID: ENST00000434659
  CDS Start-End: 107-508
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcgatttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146267 - DNA, 1240 bp, Homo sapiens
  Payload ID: 8975
  Gene Symbol: KIR3DX1
  Gene Name: killer cell immunoglobulin-like receptor, three domains, X1
  ENST ID: ENST00000622805
  CDS Start-End: 107-526
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146268 - DNA, 2548 bp, Homo sapiens
  Payload ID: 8975
  Gene Symbol: KIR3DX1
  Gene Name: killer cell immunoglobulin-like receptor, three domains, X1
  ENST ID: ENST00000622318
  CDS Start-End: 1-362
ctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcgaaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctccccaactttagaaggtactttgtaatattctcccccacaactttagaaggtactttgtaatattctcccctccccttaagaaggtactttgtaatattctcccccacaactttagaaggtactttgtaatattctcccctccccttaagaaggtacttcgaggctgggtgcggtggctcatgtctgtaatcccagcactctggggggccgaggtgggtggatcatgaggtcaggagatcgagaccatcctggctaatgtggtgaaaccccgtctctactaaaaaaatacaaaacaattagctgggcatggtggcgggtgcctgtagtcccagccacttgggagtctgaggcaggagaatggcgtgaacccaggaggcagagcttgcagtgagctgagatcgcgccactgcactccagcctgggcgatagagcaagactctgtctcaaaaaaaaaaaaaaaaaaaaaaaaaaaaa

SEQ ID NO: 146269 - DNA, 1378 bp, Homo sapiens
  Payload ID: 8975
  Gene Symbol: KIR3DX1
  Gene Name: killer cell immunoglobulin-like receptor, three domains, X1
  Uniprot ID: Q9H7L2
  ENST ID: ENST00000614511
  CDS Start-End: 8-1066
tggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacg

SEQ ID NO: 146270 - DNA, 3011 bp, Homo sapiens
  Payload ID: 8975
  Gene Symbol: KIR3DX1
  Gene Name: killer cell immunoglobulin-like receptor, three domains, X1
  ENST ID: ENST00000620623
  CDS Start-End: 39-1136
agctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctcccccacaactttagaaggtactttgtaatattctcccccacaactttagaaggtactttgtaatattctcccccacaactttagaaggtactttgtaatattctcccccacaactttagaaggtactttgtaatattctcccccacaactttagaaggtactt

SEQ ID NO: 146271 - DNA, 1222 bp, Homo sapiens
  Payload ID: 8975
  Gene Symbol: KIR3DX1
  Gene Name: killer cell immunoglobulin-like receptor, three domains, X1
  ENST ID: ENST00000615010
  CDS Start-End: 107-508
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146272 - DNA, 1378 bp, Homo sapiens
  Payload ID: 8975
  Gene Symbol: KIR3DX1
  Gene Name: killer cell immunoglobulin-like receptor, three domains, X1
  Uniprot ID: Q9H7L2
  ENST ID: ENST00000621920
  CDS Start-End: 8-1066
tggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatcacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcgaaggatcctagtatctacatcactgtccaccaagcccaggctgaggccagagctgcccccagtctttggcacaaagggcattaatacg

SEQ ID NO: 146273 - DNA, 3325 bp, Homo sapiens
  Payload ID: 8975
  Gene Symbol: KIR3DX1
  Gene Name: killer cell immunoglobulin-like receptor, three domains, X1
  ENST ID: ENST00000610811
  CDS Start-End: 39-1136
agctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcgatttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggcttgttcacaaaaccctccatctcagcgcacccaagctccctggtgcatgcaggagccagggtgagcctgcgctgtcactcagaactggcctttgatgaatttatcttatacaaagaggggcacatacagcattcccagcagcttgaccaggggatggaggctgggatccattacgtcgaggctgtcttttccatgggtcctgtaacgcctgcccatgcaggagcctacagatgctgtggttgtttcagtcactcccgctatgagtggtcggctcccagtgaccccctggacattgtgatcacaggaaaatacaaaaagccttctctctccacccaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctccccaactttagaaggtactttgtaatattctcccccacaactttagaaggtactttgtaatattctcccctccccttaagaaggtactttgtaatattctcccccacaactttagaaggtactttgtaatattctcccctccccttaagaaggtacttcgaggctgggtgcggtggctcatgtctgtaatcccagcactctggggggccgaggtgggtggatcacgaggtcaggagatcgagaccatcctggctaatgtggtgaaaccccgtctctactaaaaaaatacaaaacaattagctgggcatggtggcgggtgcctgtagtcccagccacttgggagtctgaggcaggagaatggcgtgaacccaggaggcagagcttgcagtgagctgagatcgcgccactgcactccagcctgggcgatagagcaagactctgtctcaaaaaaaaaaaaaaaaaaaaaaaaaaaaagaa

SEQ ID NO: 146274 - DNA, 1333 bp, Homo sapiens
  Payload ID: 8975
  Gene Symbol: KIR3DX1
  Gene Name: killer cell immunoglobulin-like receptor, three domains, X1
  ENST ID: ENST00000612726
  CDS Start-End: 107-508
ggcaccctctaaactctgcaaactgaaactggaaccatggttaccacatcctgttcattttccaatttagctcaacccctgtgtcctgcccaatagaagtggcaccatggcccccaaactcatcaccgtcctgtgtctgggattctgcctgaaccagaagatctgcccacatgcgggtgctcaggacaagttctccctgtcagcctggccgagccctgtggttcccctaggaggacgtgtgactctctcctgtcattcccatcttcggtttgtcatatggacaatattccaaacaactgggacccgaagccatgagttgcacactggcctttccaacaacatcaccatcagccctgtgaccccagaacacgcagggacctacagatgtgttggaatttacaagcacgcctcaaagtggtcagctgagagcaactccctgaagatcatcgtcacaggtggaccccatgatgaggctgggagagaagttgaccctcttctgcagctctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacacacctcgccctcaaggacagtccagcaacctgcatatgctcactggactctcagtagccatcatctccattggcgtttgcctctctgcttttattggtttctggtgttacataaaatatctgggggaggctggatcacgctgcagcctcaggcacgcccttgccttgttttggtcttggtattgccacctctgaagtgaagatctggaagactttctttttcaccccacagacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagc

SEQ ID NO: 146275 - DNA, 1378 bp, Homo sapiens; identical to SEQ ID NO: 146269
  Payload ID: 8975
  Gene Symbol: KIR3DX1
  Gene Name: killer cell immunoglobulin-like receptor, three domains, X1
  Uniprot ID: Q9H7L2
  ENST ID: ENST00000614591
  CDS Start-End: 8-1066

SEQ ID NO: 146276 - DNA, 2548 bp, Homo sapiens
  Payload ID: 8975
  Gene Symbol: KIR3DX1
  Gene Name: killer cell immunoglobulin-like receptor, three domains, X1
  ENST ID: ENST00000613278
  CDS Start-End: 1-362
ctgaaatctcatttgaccagtaccatctgttcagacacggggttgctcatggacagtggctcagtggagggcagagacacagggaagcattccaggccaacttttctgtgggccgtgcaacgccagtccctggcgggacctatagatgctatggttccttcaatgactctccctataagcccccagtgacccgctgcaactttacaccacaggaaacactaagagtactcctctgtcattcacagaatccacccctgaatctgacaccaccatggcaaacacagagcccacggaaggccaacggacggatgaagaggagcctgcagcagaagagacacaggagatcatatatgcccagttaaaccaccaggccctctcacagacaggattccctcctgcctcccagtgtccccactacctctcggaggatcctagtatctacatcactgtccaccaagcccaggctgaggccagagctgcccccagtctttggcacaaagggcattaatacgcaaggacctggatctattcctaggaggattttttttccacggacattcttcctccttctggtaccatcttgacacctcgaagctggcaacagcagtgtctgaatgcttgtgggattatcttaaaattccagcactgctgaacagacaactagccattctacaattctattttgagcatccaaccatttaaggtgatttgactctacccacacactcatcctggatatctcattaatatcatctgagttatcctgaaactctacagacatgcttctggaaagccgatgtatatgctcagccagtttaatctctaaattactcaataaggtttttttaaaaaaatttttttaaagttctggggtacatgctcaggatgtgcaggtttgttacgtaggtaaacgtgtgccatggtggtttgctgcacctatcaaaccgtcacctaggtattaagcccagcaggcattagctctcttccctaatgctctccataccccctgccctcctctgacaggccccagtgaatgtgttcccctccctgtgtccatgtgttctcattgttcagctcccacttataagtgaaaacatgcggtgtctggttttctgttcctgcattagtttgctgaggataatgtcttctagcttcattcatgtctctgcaaatgatatgatctcattcctttttatgactgcgtagtattccgtggtgtatatgtacaactttatttttatccagtctatcattgatgggcatttgggttgattccacgtctttgctgttactcaacaaaattttgcagagatgaagtgtattctatatctgagtcatctaatatggtagccactagccaaatatggctttttaacttagaattagaatagatcaaattccatgaagtttaaaattcagttcctcagccacatggccacaatttgagttctcagagccacgtgtggctgctggctgtgggagagaatagcatgaacacaaaatgttttccttgtcagaggaagttctagctgttctagattaaaggtgcaaatttgaagatgcagagcctattttctcatgcagtgcaggctcctggaagagacctaatgtaacaaaacgataatatttcacatcaatggtgacatgtctttatcttacgaaatgcggggaacaagcagagttctcttgtggagtgtcttatcacctcttatcctcatgcaaatttctgccatagagattttctcccaaactttgagaaggtcacctctgtcaggcctctgagcccaagctaagccatcctatcccctgtgacctgcacgtacacatccagatggcctgaagcaactgaagattcacaaaagaagtgaaaatagccttaactgatgacattccaccactgtgacttgttcccgccccactaactgataccatatattctgccccgcccaagaaggtactttgtaatattcctcgcccccttaccccccaccgccctgcccccgctcgcccgccttaagaaggtactttgtaatattctcccccacaactttagaaggtactttgtaatattctccccaactttagaaggtactttgtaatattctcccccacaactttagaaggtactttgtaatattctcccctccccttaagaaggtactttgtaatattctcccccacaactttagaaggtactttgtaatattctcccctccccttaagaaggtacttcgaggctgggtgcggtggctcatgtctgtaatcccagcactctggggggccgaggtgggtggatcacgaggtcaggagatcgagaccatcctggctaatgtggtgaaaccccgtctctactaaaaaaatacaaaacaattagctgggcatggtggcgggtgcctgtagtcccagccacttgggagtctgaggcaggagaatggcgtgaacccaggaggcagagcttgcagtgagctgagatcgcgccactgcactccagcctgggcgatagagcaagactctgtctcaaaaaaaaaaaaaaaaaaaaaaaaaaaaa

SEQ ID NO: 146277 - DNA, 1203 bp, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000291633
  CDS Start-End: 27-1151
ggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccgagaggatgtttcaccacgttggccaagcttgtctgaaactcccaacctcaagtgatccgaccgtctcagcatgccaaagtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtct

SEQ ID NO: 146278 - DNA, 1596 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000336077
  CDS Start-End: 41-1087
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146279 - DNA, 1341 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000612504
  CDS Start-End: 90-1136
tgtaaactgcatgggcagggcgccaaataacatcctgtgcgctgctgagctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaa

SEQ ID NO: 146280 - DNA, 1406 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000619424
  CDS Start-End: 38-1084
agctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactca

SEQ ID NO: 146281 - DNA, 1401 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616302
  CDS Start-End: 33-1079
ggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactca

SEQ ID NO: 146282 - DNA, 1586 bp, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000611611
  CDS Start-End: 27-1073
ggctgcctgtctgctccggcagcaccatgtcgctcttgttcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146283 - DNA, 1212 bp, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000620449
  CDS Start-End: 27-1151
ggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccgagaggatgtttcaccacgttggccaagcttgtctgaaactcccaacctcaagtgatccgaccgtctcagcatgccaaagtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgg

SEQ ID NO: 146284 - DNA, 1341 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616310
  CDS Start-End: 90-1136
tgtaaactgcatgggcagggcgccaaataacatcctgtgcgctgctgagctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaa

SEQ ID NO: 146285 - DNA, 1586 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000620588
  CDS Start-End: 27-1073
ggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146286 - DNA, 1588 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616076
  CDS Start-End: 33-1079
ggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146287 - DNA, 1372 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000614564
  CDS Start-End: 39-1085
gagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaacccccgacacctgcacattctgattgggacctcagtggtcatcatcctcttcatcctcctcttctttctccttcattgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagagagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaaccttactggcttacttccta

SEQ ID NO: 146288 - DNA, 1587 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000614869
  CDS Start-End: 30-1076
cgcggccgactgtctgcacagacagcaccatgtcgctcatggtcgtcagcatggcgtgtgttgggttcttcttgctgcagggggcctggccacatgagggagtccacagaaaaccttccctccgggcccacccaggtcccctggtgaaatcagaagagacagtcatcctgcaatgttggtcagatgtcaggtttgagcacttccttctgcacagagaagggaagtttaaggacactttgcgcctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctgttccacctcccctcagactagctttcagccttctgtcagcagtaaaacttatatattttttaaaataacttcaatgtagttttccatccttcaaataaacatgtctgccctcatg

SEQ ID NO: 146289 - DNA, 1600 bp, Homo sapiens
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000622463
  CDS Start-End: 41-1087
ctgagctcggtcgcggctgcctgtctgctccggcagcaccatgtcgctcttgttcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146290 - DNA, 1593 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000612069
  CDS Start-End: 38-1084
agctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146291 - DNA, 1406 bp, Homo sapiens; identical to SEQ ID NO: 146280
  Payload ID: 8976
  Gene Symbol: KIR2DL1
  Gene Name: killer cell immunoglobulin-like receptor, two domains, long cytoplasmic tail, 1
  ENST ID: ENST00000618507
  CDS Start-End: 38-1084

SEQ ID NO: 146292 - DNA, 1212 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000612312
  CDS Start-End: 27-1151
ggctgcctgtctgctccggcagcaccatgtcgctcttgttcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccgagaggatgtttcaccacgttggccaagcttgtctgaaactcccaacctcaagtgatccgaccgtctcagcatgccaaagtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgg

SEQ ID NO: 146293 - DNA, 1320 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000618987
  CDS Start-End: 41-1087
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagtt

SEQ ID NO: 146294 - DNA, 1600 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000617247
  CDS Start-End: 41-1087
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctctcttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146295 - DNA, 1320 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616175
  CDS Start-End: 41-1087
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaacccccgacacctgcacattctgattgggacctcagtggtcatcatcctcttcatcctcctcttctttctccttcattgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagtt

SEQ ID NO: 146296 - DNA, 1212 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616631
  CDS Start-End: 27-1151
ggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccgagaggatgtttcaccacgttggccaagcttgtctgaaactcccaacctcaagtgatccgaccgtctcagcatgccaaagtaacccccgacacctgcacattctgattgggacctcagtggtcatcatcctcttcatcctcctcttctttctccttcattgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgg

SEQ ID NO: 146297 - DNA, 862 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000614185
  CDS Start-End: 1-349
gtctcatcttcttccaggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146298 - DNA, 1600 bp, Homo sapiens; identical to SEQ ID NO: 146289
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000615920
  CDS Start-End: 41-1087

SEQ ID NO: 146299 - DNA, 1572 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000615298
  CDS Start-End: 15-1061
gctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaagaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 146300 - DNA, 1406 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000613465
  CDS Start-End: 38-1084
agctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaacccccgacacctgcacattctgattgggacctcagtggtcatcatcctcttcatcctcctcttctttctccttcattgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactca

SEQ ID NO: 146301 - DNA, 1588 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000610327
  CDS Start-End: 33-1079
ggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146302 - DNA, 1536 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000611594
  CDS Start-End: 37-1083
gctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatatt

SEQ ID NO: 146303 - DNA, 1454 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000612129
  CDS Start-End: 12-1058
cagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgatcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctg

SEQ ID NO: 146304 - DNA, 1406 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000610627
  CDS Start-End: 38-1084
agctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcccggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactca

SEQ ID NO: 146305 - DNA, 1212 bp, Homo sapiens; identical to SEQ ID NO: 146283
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000618563
  CDS Start-End: 27-1151

SEQ ID NO: 146306 - DNA, 1212 bp, Homo sapiens; identical to SEQ ID NO: 146283
  Payload ID: 8976
  Gene Symbol: KIR2DL1
  Gene Name: killer cell immunoglobulin-like receptor, two domains, long cytoplasmic tail, 1
  Uniprot ID: P43626
  ENST ID: ENST00000617376
  CDS Start-End: 27-1151

SEQ ID NO: 146307 - DNA, 1585 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000617127
  CDS Start-End: 30-1076
cgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccacacatacaagaggctccgtcttaacgcagcacttagacacgtgctgttccaccttccctcatgctgttccacctcccctcagactagctttcagccttctgtcagcagtaaaacttatatattttttaaaataacttcaatgtagttttccatccttcaaataaacatgtctgccctca

SEQ ID NO: 146308 - DNA, 1212 bp, Homo sapiens; identical to SEQ ID NO: 146292
  Payload ID: 8976
  Gene Symbol: KIR2DL1
  Gene Name: killer cell immunoglobulin-like receptor, two domains, long cytoplasmic tail, 1
  ENST ID: ENST00000611849
  CDS Start-End: 27-1151

SEQ ID NO: 146309 - DNA, 1320 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000613580
  CDS Start-End: 41-1087
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcagtgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacatcgtgatcataggtctatatgagaaaccttctctctcagcccagctgggccccacggttctggcaggagagaatgtgaccttgtcctgcagctcctggagctcctatgacatgtaccatctatccagggaaggggaggcccatgaacgtaggctccctgcagggcccaaggtcaacggaacattccaggctgactttcctctgggccctgccacccacggagggacctacagatgcttcggctctttccatgactctccatacgagtggtcaaagtcaagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagtt

SEQ ID NO: 146310 - DNA, 1576 bp, Homo sapiens
  Payload ID: 8976
  Gene Symbol: KIR2DL1
  Gene Name: killer cell immunoglobulin-like receptor, two domains, long cytoplasmic tail, 1
  ENST ID: ENST00000616642
  CDS Start-End: 21-1067
ctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgacgcaagacctggcagggacctacagatgctacggttctgttactcactccccctatcaggtgtcagctcccagtgaccctctggacgtcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaacccccgacacctgcacattctgattgggacctcagtggtcatcatcctcttcatcctcctcttctttctccttcattgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146311 - DNA, 1598 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000613810
  CDS Start-End: 39-1085
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146312 - DNA, 1598 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000620664
  CDS Start-End: 39-1085
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagctctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146313 - DNA, 1509 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000618906
  CDS Start-End: 1-996
atgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146314 - DNA, 1572 bp, Homo sapiens
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000618388
  CDS Start-End: 15-1061
gcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcataggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 146315 - DNA, 1598 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000614566
  CDS Start-End: 39-1085
gagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146316 - DNA, 1598 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000619239
  CDS Start-End: 39-1085
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146317 - DNA, 1598 bp, Homo sapiens; identical to SEQ ID NO: 146311
  Payload ID: 8977
  Gene Symbol: KIR2DL2
  Gene Name: killer cell immunoglobulin-like receptor, two domains, long cytoplasmic tail, 2
  ENST ID: ENST00000613017
  CDS Start-End: 39-1085

SEQ ID NO: 146318 - DNA, 1572 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000621461
  CDS Start-End: 15-1061
gcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 146319 - DNA, 1169 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000613022
  CDS Start-End: 3-917
ccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatctta

SEQ ID NO: 146320 - DNA, 1371 bp, Homo sapiens
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000618796
  CDS Start-End: 30-1076
cgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcataggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctactt

SEQ ID NO: 146321 - DNA, 1593 bp, Homo sapiens
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000616831
  CDS Start-End: 38-1084
agctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcataggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagctctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146322 - DNA, 1598 bp, Homo sapiens; identical to SEQ ID NO: 146311
  Payload ID: 8977
  Gene Symbol: KIR2DL2
  Gene Name: killer cell immunoglobulin-like receptor, two domains, long cytoplasmic tail, 2
  ENST ID: ENST00000616462
  CDS Start-End: 39-1085

SEQ ID NO: 146323 - DNA, 1645 bp, Homo sapiens
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000611724
  CDS Start-End: 90-1136
tgtaaactgcatgggcagggcgccaaataacatcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcataggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacgcggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146324 - DNA, 1419 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000612594
  CDS Start-End: 90-1136
tgtaaactgcatgggcagggcgccaaataacatcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttactt

SEQ ID NO: 146325 - DNA, 1371 bp, Homo sapiens; identical to SEQ ID NO: 146320
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000619621
  CDS Start-End: 30-1076

SEQ ID NO: 146326 - DNA, 1587 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000618870
  CDS Start-End: 32-1078
ggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccca

SEQ ID NO: 146327 - DNA, 1572 bp, Homo sapiens; identical to SEQ ID NO: 146314
  Payload ID: 8977
  Gene Symbol: KIR2DL2
  Gene Name: killer cell immunoglobulin-like receptor, two domains, long cytoplasmic tail, 2
  Uniprot ID: P43627
  ENST ID: ENST00000613410
  CDS Start-End: 15-1061

SEQ ID NO: 146328 - DNA, 1260 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000617258
  CDS Start-End: 1-747
atgtcgctcatggtcgtcagcatggcgtgtgttgggttcttcttgctgcagggggcctggccacatgagggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatggt

SEQ ID NO: 146329 - DNA, 1371 bp, Homo sapiens
  Payload ID: 8977
  Gene Symbol: KIR2DL2
  Gene Name: killer cell immunoglobulin-like receptor, two domains, long cytoplasmic tail, 2
  ENST ID: ENST00000614650
  CDS Start-End: 30-1076
cgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcaggtttgagcacttccttctgcacagagaagggaagtttaaggacactttgcacctcattggagagcaccatgatggggtctccaaagccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaatgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctctaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcagggaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcatgagtctgcatcttagggcatcgctcttcctcacaccacaaatctgaatgtgcctctcacttgcttacaaatgtctaaggtccccactgcctgctggagaaaaaacacactcctttgcttagcccacagttctccatttcacttgacccctgcccacctctccaacctaactggcttacttcctagtctactt

SEQ ID NO: 146330 - DNA, 1598 bp, Homo sapiens; identical to SEQ ID NO: 146311
  Payload ID: 8977
  Gene Symbol: KIR2DL2
  Gene Name: killer cell immunoglobulin-like receptor, two domains, long cytoplasmic tail, 2
  ENST ID: ENST00000617820
  CDS Start-End: 39-1085

SEQ ID NO: 146331 - DNA, 1419 bp, Homo sapiens; identical to SEQ ID NO: 146324
  Payload ID: 8977
  Gene Symbol: KIR2DL2
  Gene Name: killer cell immunoglobulin-like receptor, two domains, long cytoplasmic tail, 2
  ENST ID: ENST00000611206
  CDS Start-End: 90-1136

SEQ ID NO: 146332 - DNA, 1572 bp, Homo sapiens; identical to SEQ ID NO: 146318
  Payload ID: 8977
  Gene Symbol: KIR2DL2
  Gene Name: killer cell immunoglobulin-like receptor, two domains, long cytoplasmic tail, 2
  ENST ID: ENST00000622658
  CDS Start-End: 15-1061

SEQ ID NO: 146333 - DNA, 1598 bp, Homo sapiens; identical to SEQ ID NO: 146316
  Payload ID: 8977
  Gene Symbol: KIR2DL2
  Gene Name: killer cell immunoglobulin-like receptor, two domains, long cytoplasmic tail, 2
  ENST ID: ENST00000612992
  CDS Start-End: 39-1085

SEQ ID NO: 146334 - DNA, 1587 bp, Homo sapiens; identical to SEQ ID NO: 146326
  Payload ID: 8977
  Gene Symbol: KIR2DL2
  Gene Name: killer cell immunoglobulin-like receptor, two domains, long cytoplasmic tail, 2
  ENST ID: ENST00000622560
  CDS Start-End: 32-1078

SEQ ID NO: 146335 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000342376
  CDS Start-End: 32-1057
ggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146336 - DNA, 1601 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000613321
  CDS Start-End: 39-1088
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 146337 - DNA, 1377 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000621438
  CDS Start-End: 39-1088
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagt

SEQ ID NO: 146338 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000615739
  CDS Start-End: 32-1057
ggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggctttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctctcttgcttacaaatgtctaaggtccccactgcctgctggagagaaaacacactcctttgcttagcccacaattctccatttcacttgacccctgcccacctctccaacctaactggcttacttcctagtctatttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146339 - DNA, 1601 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000613343
  CDS Start-End: 39-1088
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagaaaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 146340 - DNA, 1585 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000611207
  CDS Start-End: 23-1048
gcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctcatggt

SEQ ID NO: 146341 - DNA, 1596 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000610407
  CDS Start-End: 38-1063
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggctttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctctcttgcttacaaatgtctaaggtccccactgcctgctggagagaaaacacactcctttgcttagcccacaattctccatttcacttgacccctgcccacctctccaacctaactggcttacttcctagtctatttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146342 - DNA, 1377 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000621458
  CDS Start-End: 39-1088
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggctttcacccactgaaccaagctccgaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagt

SEQ ID NO: 146343 - DNA, 1590 bp, Homo sapiens; identical to SEQ ID NO: 146335
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000611990
  CDS Start-End: 32-1057

SEQ ID NO: 146344 - DNA, 1601 bp, Homo sapiens; identical to SEQ ID NO: 146339
  Payload ID: 8978
  Gene Symbol: KIR2DL3
  Gene Name: killer cell immunoglobulin-like receptor, two domains, long cytoplasmic tail, 3
  ENST ID: ENST00000610484
  CDS Start-End: 39-1088

SEQ ID NO: 146345 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000617657
  CDS Start-End: 39-1088

SEQ ID NO: 146346 - DNA, 1311 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000619995
  CDS Start-End: 41-1066
ctgagctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgct

SEQ ID NO: 146347 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000622627
  CDS Start-End: 39-1088

SEQ ID NO: 146348 - DNA, 1596 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000619702
  CDS Start-End: 38-1063
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146349 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000610480
  CDS Start-End: 39-1088

SEQ ID NO: 146350 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000617150
  CDS Start-End: 32-1057
ggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggctttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146351 - DNA, 1596 bp, Homo sapiens; identical to SEQ ID NO: 146348
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000614792
  CDS Start-End: 38-1063

SEQ ID NO: 146352 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000622307
  CDS Start-End: 30-1079
cgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatg

SEQ ID NO: 146353 - DNA, 1344 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000617790
  CDS Start-End: 90-1115
tgtaaactgcatgggcagggcgccaaataacatcctgtgcgctgctgagctgagctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaa

SEQ ID NO: 146354 - DNA, 1601 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000620925
  CDS Start-End: 39-1088
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggactctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 146355 - DNA, 1572 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000617404
  CDS Start-End: 14-1039
cacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagtctagctttcagccttctgtcagcagtaaaacttatatattttttaaaataatttcaatgtagttttccctccttcaaataaacatgtctgccctca

SEQ ID NO: 146356 - DNA, 1566 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000616520
  CDS Start-End: 8-1033
cagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtttccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 146357 - DNA, 1601 bp, Homo sapiens; identical to SEQ ID NO: 146354
  Payload ID: 8978
  Gene Symbol: KIR2DL3
  Gene Name: killer cell immunoglobulin-like receptor, two domains, long cytoplasmic tail, 3
  ENST ID: ENST00000610900
  CDS Start-End: 39-1088

SEQ ID NO: 146358 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000617542
  CDS Start-End: 39-1088

SEQ ID NO: 146359 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000622644
  CDS Start-End: 32-1057
ggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagagtatctttcagccttctgtcagcagtaaaacttatatattttttaaaataatttcaatgtagttttccctccttcaaataaacatgtctgccctca

SEQ ID NO: 146360 - DNA, 1587 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000616840
  CDS Start-End: 30-1076
cgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccccgacacctgcacattctgattgggacctcagtggtcatcatcctcttcatcctcctcttctttctccttcatcgctggtgctccaacaaaaaaaatgctgcggtaatggaccaagagtctgcaggaaacagaacagcgaatagcgaggactctgatgaacaagaccctcaggaggtgacatacacacagttgaatcactgcgttttcacacagagaaaaatcactcgcccttctcagaggcccaagacacccccaacagatatcatcgtgtacacggaacttccaaatgctgagtccagatccaaagttgtctcctgcccatgagcaccacagtcaggccttgagggcgtcttctagggagacaacagccctgtctcaaaaccgggttgccagctcccatgtaccagcagctggaatctgaaggcgtgagtctgcatcttagggcatcgatcttcctcacaccacaaatctgaatgtgcctctcacttgcttacaaatgtctaaggtccccactgcctgctggagaaaaaacacactcctttgcttaacccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgcccccatg

SEQ ID NO: 146361 - DNA, 1579 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000617593
  CDS Start-End: 22-1047
cctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctc

SEQ ID NO: 146362 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000616745
  CDS Start-End: 39-1088

SEQ ID NO: 146363 - DNA, 1596 bp, Homo sapiens; identical to SEQ ID NO: 146348
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000620549
  CDS Start-End: 38-1063

SEQ ID NO: 146364 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000621037
  CDS Start-End: 39-1088

SEQ ID NO: 146365 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000612295
  CDS Start-End: 39-1088

SEQ ID NO: 146366 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000618401
  CDS Start-End: 39-1088

SEQ ID NO: 146367 - DNA, 1596 bp, Homo sapiens; identical to SEQ ID NO: 146348
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000615091
  CDS Start-End: 38-1063

SEQ ID NO: 146368 - DNA, 1601 bp, Homo sapiens; identical to SEQ ID NO: 146336
  Payload ID: 8978
  Gene Symbol: KIR2DL3
  Gene Name: killer cell immunoglobulin-like receptor, two domains, long cytoplasmic tail, 3
  ENST ID: ENST00000612755
  CDS Start-End: 39-1088

SEQ ID NO: 146369 - DNA, 1596 bp, Homo sapiens; identical to SEQ ID NO: 146348
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000617242
  CDS Start-End: 38-1063

SEQ ID NO: 146370 - DNA, 1596 bp, Homo sapiens; identical to SEQ ID NO: 146348
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000611369
  CDS Start-End: 38-1063

SEQ ID NO: 146371 - DNA, 1590 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000617853
  CDS Start-End: 32-1081
ggcgcggccgactgtctgcacagacagcaccatgtcgctcatggtcgtcagcatggcgtgtgttgggttcttcttgctgcagggggcctggccacatgagggagtccacagaaaaccttccctccgggcccacccaggtcccctggtgaaatcagaagagacagtcatcctgcaatgttggtcagatgtcaggtttgagcacttccttctgcacagagaagggaagtttaaggacactttgcgcctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctgcacgttctgattgggacctcagtggtcatcatcctcttcgtcctcctcctcttctttctccttcatcgctggtgctccaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagcccagatccaaagttgtctcctgcccatgagcaccacagtcaggccttgaggggatcttctagggagacaacagccctgtctcaaaactgggttgccagctcccatgtaccagcagctggaatctgaaggcgtcagtctgcgtcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatgcaagtggctccctcttaacacggcacttagacacgtgctgttccaccttccctcatgctgttccacctcccctcagactagctttcagccttctgtcagcagtaaaacttatatattttttaaaataatttcaatgtagttttcccgccttcaaataaacatgtctgccctca

SEQ ID NO: 146372 - DNA, 1377 bp, Homo sapiens; identical to SEQ ID NO: 146337
  Payload ID: 8978
  Gene Symbol: KIR2DL3
  Gene Name: killer cell immunoglobulin-like receptor, two domains, long cytoplasmic tail, 3
  ENST ID: ENST00000618446
  CDS Start-End: 39-1088

SEQ ID NO: 146373 - DNA, 1464 bp, Homo sapiens
  Payload ID: 8978
  Gene Symbol: KIR2DL3
  Gene Name: killer cell immunoglobulin-like receptor, two domains, long cytoplasmic tail, 3
  Uniprot ID: P43628
  ENST ID: ENST00000611821
  CDS Start-End: 20-1045
tgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgct

SEQ ID NO: 146374 - DNA, 1601 bp, Homo sapiens
  Payload ID: 8978
  Gene Symbol: KIR2DL3
  Gene Name: killer cell immunoglobulin-like receptor, two domains, long cytoplasmic tail, 3
  ENST ID: ENST00000622758
  CDS Start-End: 39-1088
gagctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtttccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtagcccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 146375 - DNA, 1447 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000345540
  CDS Start-End: 13-1041
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146376 - DNA, 1026 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000346587
  CDS Start-End: 1-744
atgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccac

SEQ ID NO: 146377 - DNA, 1396 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000357494
  CDS Start-End: 13-990
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146378 - DNA, 1580 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000359085
  CDS Start-End: 42-863
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146379 - DNA, 1656 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000396284
  CDS Start-End: 1-1251
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146380 - DNA, 1601 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000396289
  CDS Start-End: 1-1195
catgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146381 - DNA, 715 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000396293
  CDS Start-End: 12-704
gaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtc

SEQ ID NO: 146382 - DNA, 1191 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000610662
  CDS Start-End: 203-1141
tctagtctgcagttttcagaaaccctcattcctcccttgactgactcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattt

SEQ ID NO: 146383 - DNA, 1022 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000618013
  CDS Start-End: 3-740
ccatgtcacccacggtcatcatcctggcatgtcttgggttcttcttggaccagagtgtgtgggcacacgtgggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccac

SEQ ID NO: 146384 - DNA, 715 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622322
  CDS Start-End: 12-704
gaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtc

SEQ ID NO: 146385 - DNA, 1189 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000612879
  CDS Start-End: 47-784
tcgagccgagtcactgcgtcctggcagcagaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146386 - DNA, 1536 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000620484
  CDS Start-End: 1-1134
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaagacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146387 - DNA, 1596 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000618648
  CDS Start-End: 1-1194
atgtcgctcatggtcgtcagcatggcgtgtgttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146388 - DNA, 1656 bp, Homo sapiens; identical to SEQ ID NO: 146379
  Payload ID: 8979
  Gene Symbol: KIR2DL4
  Gene Name: killer cell immunoglobulin-like receptor, two domains, long cytoplasmic tail, 4
  ENST ID: ENST00000619946
  CDS Start-End: 1-1251

SEQ ID NO: 146389 - DNA, 1346 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000618297
  CDS Start-End: 19-1152
ggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctact

SEQ ID NO: 146390 - DNA, 1730 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000615970
  CDS Start-End: 191-1324
ttttcagaaaccctcattcctcccttgactgactcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146391 - DNA, 1443 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000614680
  CDS Start-End: 13-1041
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146392 - DNA, 1447 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000615139
  CDS Start-End: 13-1041
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146393 - DNA, 1580 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621031
  CDS Start-End: 42-863
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146394 - DNA, 1022 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622255
  CDS Start-End: 1-740
ccatgtcacccacggtcatcatcctggcatgtcttgggttcttcttggaccagagtgtgtgggcacacgtgggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaagacggcacttagacacgtgctgttccac

SEQ ID NO: 146395 - DNA, 1536 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000614653
  CDS Start-End: 1-1134
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctctctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146396 - DNA, 1581 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000619637
  CDS Start-End: 42-1175
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146397 - DNA, 1548 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000620007
  CDS Start-End: 13-1146
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146398 - DNA, 1145 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622882
  CDS Start-End: 1-1134
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtc

SEQ ID NO: 146399 - DNA, 1637 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622365
  CDS Start-End: 203-1231
tctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146400 - DNA, 1792 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000615396
  CDS Start-End: 191-1390
ttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146401 - DNA, 1566 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000618607
  CDS Start-End: 28-849
ctgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146402 - DNA, 1191 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000614619
  CDS Start-End: 203-1141
tctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattt

SEQ ID NO: 146403 - DNA, 1474 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000621182
  CDS Start-End: 41-1069
tcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146404 - DNA, 1497 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000612660
  CDS Start-End: 13-1095
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaagacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146405 - DNA, 1581 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619868
  CDS Start-End: 42-1175
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146406 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000614599
  CDS Start-End: 203-1231

SEQ ID NO: 146407 - DNA, 1474 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000616384
  CDS Start-End: 41-1069
tcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146408 - DNA, 1392 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619882
  CDS Start-End: 13-990
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146409 - DNA, 715 bp, Homo sapiens; identical to SEQ ID NO: 146381
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000615232
  CDS Start-End: 12-704

SEQ ID NO: 146410 - DNA, 1443 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000611437
  CDS Start-End: 13-1041
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146411 - DNA, 1566 bp, Homo sapiens; identical to SEQ ID NO: 146401
  Payload ID: 8979
  Gene Symbol: KIR2DL4
  Gene Name: killer cell immunoglobulin-like receptor, two domains, long cytoplasmic tail, 4
  ENST ID: ENST00000622437
  CDS Start-End: 28-849

SEQ ID NO: 146412 - DNA, 1489 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621932
  CDS Start-End: 1-1083
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146413 - DNA, 1656 bp, Homo sapiens; identical to SEQ ID NO: 146379
  Payload ID: 8979
  Gene Symbol: KIR2DL4
  Gene Name: killer cell immunoglobulin-like receptor, two domains, long cytoplasmic tail, 4
  ENST ID: ENST00000621258
  CDS Start-End: 1-1251

SEQ ID NO: 146414 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000620369
  CDS Start-End: 203-1231

SEQ ID NO: 146415 - DNA, 1656 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000613824
  CDS Start-End: 1-1251
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146416 - DNA, 1548 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000619848
  CDS Start-End: 13-1146
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146417 - DNA, 1567 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000614379
  CDS Start-End: 28-1161
ctgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146418 - DNA, 1575 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000610911
  CDS Start-End: 33-854
agtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattct

SEQ ID NO: 146419 - DNA, 1474 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000618955
  CDS Start-End: 41-1069
tcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146420 - DNA, 1742 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619802
  CDS Start-End: 203-1336
tctagtctgcagttttcagaaaccctcattcctcccttgactgactcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146421 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000617052
  CDS Start-End: 203-1231

SEQ ID NO: 146422 - DNA, 1597 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619195
  CDS Start-End: 1-933
atgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaagacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146423 - DNA, 1642 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619980
  CDS Start-End: 33-1232
agtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattct

SEQ ID NO: 146424 - DNA, 1265 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000612389
  CDS Start-End: 277-1215
agttctgtttctttcctgcgttgatcttggacagtaactgtactatgtaaggaattgtcggtggctggcgacggtatcttagctggttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattt

SEQ ID NO: 146425 - DNA, 1656 bp, Homo sapiens; identical to SEQ ID NO: 146415
  Payload ID: 8979
  Gene Symbol: KIR2DL4
  Gene Name: killer cell immunoglobulin-like receptor, two domains, long cytoplasmic tail, 4
  ENST ID: ENST00000614427
  CDS Start-End: 1-1251

SEQ ID NO: 146426 - DNA, 1656 bp, Homo sapiens; identical to SEQ ID NO: 146415
  Payload ID: 8979
  Gene Symbol: KIR2DL4
  Gene Name: killer cell immunoglobulin-like receptor, two domains, long cytoplasmic tail, 4
  ENST ID: ENST00000618640
  CDS Start-End: 1-1251

SEQ ID NO: 146427 - DNA, 1189 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621773
  CDS Start-End: 47-784
tcgagccgagtcactgcgtcctggcagcagaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146428 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000620905
  CDS Start-End: 203-1231

SEQ ID NO: 146429 - DNA, 1539 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000612573
  CDS Start-End: 1-1134
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146430 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000620961
  CDS Start-End: 203-1231

SEQ ID NO: 146431 - DNA, 1581 bp, Homo sapiens; identical to SEQ ID NO: 146396
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000618567
  CDS Start-End: 42-1175

SEQ ID NO: 146432 - DNA, 1396 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000612364
  CDS Start-End: 13-990
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146433 - DNA, 1497 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000620486
  CDS Start-End: 13-1095
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146434 - DNA, 1392 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000615243
  CDS Start-End: 13-990
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146435 - DNA, 1580 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000620455
  CDS Start-End: 42-863
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146436 - DNA, 1536 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000611434
  CDS Start-End: 1-1134
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146437 - DNA, 1392 bp, Homo sapiens; identical to SEQ ID NO: 146408
  Payload ID: 8979
  Gene Symbol: KIR2DL4
  Gene Name: killer cell immunoglobulin-like receptor, two domains, long cytoplasmic tail, 4
  ENST ID: ENST00000610492
  CDS Start-End: 13-990

SEQ ID NO: 146438 - DNA, 1581 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000618358
  CDS Start-End: 42-1175
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctattaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146439 - DNA, 1548 bp, Homo sapiens; identical to SEQ ID NO: 146397
  Payload ID: 8979
  Gene Symbol: KIR2DL4
  Gene Name: killer cell immunoglobulin-like receptor, two domains, long cytoplasmic tail, 4
  ENST ID: ENST00000613442
  CDS Start-End: 13-1146

SEQ ID NO: 146440 - DNA, 1474 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000616667
  CDS Start-End: 41-1069
tcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146441 - DNA, 1742 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000611244
  CDS Start-End: 86-1336
tctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146442 - DNA, 1581 bp, Homo sapiens; identical to SEQ ID NO: 146438
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000616354
  CDS Start-End: 42-1175

SEQ ID NO: 146443 - DNA, 1637 bp, Homo sapiens; identical to SEQ ID NO: 146399
  Payload ID: 8979
  Gene Symbol: KIR2DL4
  Gene Name: killer cell immunoglobulin-like receptor, two domains, long cytoplasmic tail, 4
  ENST ID: ENST00000619877
  CDS Start-End: 203-1231

SEQ ID NO: 146444 - DNA, 1656 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622350
  CDS Start-End: 1-1251
atgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttc

SEQ ID NO: 146445 - DNA, 1580 bp, Homo sapiens; identical to SEQ ID NO: 146393
  Payload ID: 8979
  Gene Symbol: KIR2DL4
  Gene Name: killer cell immunoglobulin-like receptor, two domains, long cytoplasmic tail, 4
  ENST ID: ENST00000612865
  CDS Start-End: 42-863

SEQ ID NO: 146446 - DNA, 1392 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000613629
  CDS Start-End: 13-990
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146447 - DNA, 1566 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621484
  CDS Start-End: 28-849
ctgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146448 - DNA, 1656 bp, Homo sapiens; identical to SEQ ID NO: 146379
  Payload ID: 8979
  Gene Symbol: KIR2DL4
  Gene Name: killer cell immunoglobulin-like receptor, two domains, long cytoplasmic tail, 4
  ENST ID: ENST00000614253
  CDS Start-End: 1-1251

SEQ ID NO: 146449 - DNA, 1581 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621636
  CDS Start-End: 42-1175
gtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggctgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctcttcaccatccttcccttctttctccttcatcgctggtgctccaaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttca

SEQ ID NO: 146450 - DNA, 1536 bp, Homo sapiens; identical to SEQ ID NO: 146436
  Payload ID: 8979
  Gene Symbol: KIR2DL4
  Gene Name: killer cell immunoglobulin-like receptor, two domains, long cytoplasmic tail, 4
  ENST ID: ENST00000616375
  CDS Start-End: 1-1134

SEQ ID NO: 146451 - DNA, 1040 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000619043
  CDS Start-End: 1-1029
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcacaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacgcgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttatctcctgcccatgagcaccacagtcaggccttgatgggatcttctagggagacaacagccctgtctcaaacccagcttgccagctctaatgtaccagcagctggaatctgaaggcgtgagtc

SEQ ID NO: 146452 - DNA, 1547 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000621002
  CDS Start-End: 13-834
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146453 - DNA, 1804 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000618501
  CDS Start-End: 203-1402
tctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146454 - DNA, 1535 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000622348
  CDS Start-End: 1-822
atgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146455 - DNA, 1581 bp, Homo sapiens; identical to SEQ ID NO: 146396
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000613053
  CDS Start-End: 42-1175

SEQ ID NO: 146456 - DNA, 1443 bp, Homo sapiens
  Payload ID: 8979
  Gene Symbol: KIR2DL4
  Gene Name: killer cell immunoglobulin-like receptor, two domains, long cytoplasmic tail, 4
  Uniprot ID: Q99706
  ENST ID: ENST00000611022
  CDS Start-End: 13-1041
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146457 - DNA, 715 bp, Homo sapiens; identical to SEQ ID NO: 146384
  Payload ID: 8979
  Gene Symbol: KIR2DL4
  Gene Name: killer cell immunoglobulin-like receptor, two domains, long cytoplasmic tail, 4
  ENST ID: ENST00000614339
  CDS Start-End: 12-704

SEQ ID NO: 146458 - DNA, 1656 bp, Homo sapiens; identical to SEQ ID NO: 146444
  Payload ID: 8979
  Gene Symbol: KIR2DL4
  Gene Name: killer cell immunoglobulin-like receptor, two domains, long cytoplasmic tail, 4
  ENST ID: ENST00000610608
  CDS Start-End: 1-1251

SEQ ID NO: 146459 - DNA, 1496 bp, Homo sapiens
  Payload ID: 8979
  Gene Symbol: KIR2DL4
  Gene Name: killer cell immunoglobulin-like receptor, two domains, long cytoplasmic tail, 4
  ENST ID: ENST00000613149
  CDS Start-End: 13-783
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggaaggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 146460 - DNA, 1596 bp, Homo sapiens
  Payload ID: 8980
  Gene Symbol: KIR2DL5A
  Gene Name: killer cell immunoglobulin-like receptor, two domains, long cytoplasmic tail, 5A
  ENST ID: ENST00000620281
  CDS Start-End: 56-1183
ctgtgcgctgctgagctgagctggggcgcggctgcctgtctgcaccggcagcaccatgtcgctcatggtcgtcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctc

SEQ ID NO: 146461 - DNA, 1596 bp, Homo sapiens
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENST ID: ENST00000611422
  CDS Start-End: 56-1183
ctgtgcgctgctgagctgagctggggcgcggccgcctgtctgcaccggcagcaccatgtcgctcatggtcatcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctc

SEQ ID NO: 146462 - DNA, 1687 bp, Homo sapiens
  Payload ID: 8980
  Gene Symbol: KIR2DL5A
  Gene Name: killer cell immunoglobulin-like receptor, two domains, long cytoplasmic tail, 5A
  ENST ID: ENST00000620638
  CDS Start-End: 56-1183
ctgtgcgctgctgagctgagctggggcgcggccgcctgtctgcaccggcagcaccatgtcgctcatggtcatcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 146463 - DNA, 1473 bp, Homo sapiens
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENST ID: ENST00000612730
  CDS Start-End: 56-1183
ctgtgcgctgctgagctgagctggggcgcggccgcctgtctgcaccggcagcaccatgtcgctcatggtcatcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttcc

SEQ ID NO: 146464 - DNA, 1632 bp, Homo sapiens
  Payload ID: 8980
  Gene Symbol: KIR2DL5A
  Gene Name: killer cell immunoglobulin-like receptor, two domains, long cytoplasmic tail, 5A
  ENST ID: ENST00000617974
  CDS Start-End: 1-1128
atgtcgctcatggtcatcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 146465 - DNA, 1632 bp, Homo sapiens; identical to SEQ ID NO: 146464
  Payload ID: 8980
  Gene Symbol: KIR2DL5A
  Gene Name: killer cell immunoglobulin-like receptor, two domains, long cytoplasmic tail, 5A
  ENST ID: ENST00000621273
  CDS Start-End: 1-1128

SEQ ID NO: 146466 - DNA, 1632 bp, Homo sapiens
  Payload ID: 8980
  Gene Symbol: KIR2DL5A
  Gene Name: killer cell immunoglobulin-like receptor, two domains, long cytoplasmic tail, 5A
  ENST ID: ENST00000618017
  CDS Start-End: 1-1128
atgtcgctcatggtcgtcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 146467 - DNA, 1596 bp, Homo sapiens; identical to SEQ ID NO: 146461
  Payload ID: 8980
  Gene Symbol: KIR2DL5A
  Gene Name: killer cell immunoglobulin-like receptor, two domains, long cytoplasmic tail, 5A
  Uniprot ID: Q8N109
  ENST ID: ENST00000613155
  CDS Start-End: 56-1183

SEQ ID NO: 146468 - DNA, 1632 bp, Homo sapiens; identical to SEQ ID NO: 146464
  Payload ID: 8980
  Gene Symbol: KIR2DL5A
  Gene Name: killer cell immunoglobulin-like receptor, two domains, long cytoplasmic tail, 5A
  ENST ID: ENST00000621304
  CDS Start-End: 1-1128

SEQ ID NO: 146469 - DNA, 1632 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000619593
  CDS Start-End: 1-1128
atgtcgctcatggtcgtcagcatggcgtgtgttgggttcttcttgctgcagggggcctggccacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 146470 - DNA, 1395 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000615969
  CDS Start-End: 2-1129
catgtcgctcatggtcgtcagcatggcgtgtgttgggttcttcttgctgcagggggcctggacacatgagggtggacaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccgcgctcccccattgagtggtcggcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcgatggaacattccaggctgactttcctctgggccctgccacccacggagggacctacacatgcttcagctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacacacctttgcttagcccacaattctctatttcacttgacccctgcccacctctccaactgaactggcttacttcctagtctacttgaggctgcaatcacactgaggaactcacaattccagacatacaagaggctccctcttaacatggcact

SEQ ID NO: 146471 - DNA, 1632 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000618413
  CDS Start-End: 1-1128
atgtcgctcatggtcgtcagcatggcgtgtgttgggttcttcttgctgcagggggcctggacacatgagggtggtcaggacaagcccttgctgtctgcctggcccagcactgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgccagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagacttctgtcagtcagcagtgaaacttataaaattttttgtgatttcaatgtagctgtctccttttcaaataaacatgtctgccctcattgctttaggtaatgtgacgctattcgctgaaagaaaccgctgttatcattaccatgtccacataaccccatctgttatccactgggttc

SEQ ID NO: 146472 - DNA, 1632 bp, Homo sapiens; identical to SEQ ID NO: 146466
  Payload ID: 8981
  Gene Symbol: KIR2DL5B
  Gene Name: killer cell immunoglobulin-like receptor, two domains, long cytoplasmic tail, 5B
  ENST ID: ENST00000615475
  CDS Start-End: 1-1128

SEQ ID NO: 146473 - DNA, 1632 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000617104
  CDS Start-End: 1-1128
atgtcgctcatggtcgtcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 146474 - DNA, 1632 bp, Homo sapiens; identical to SEQ ID NO: 146469
  Payload ID: 8981
  Gene Symbol: KIR2DL5B
  Gene Name: killer cell immunoglobulin-like receptor, two domains, long cytoplasmic tail, 5B
  ENST ID: ENST00000611411
  CDS Start-End: 1-1128

SEQ ID NO: 146475 - DNA, 1596 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000610920
  CDS Start-End: 56-1183
ctgtgcgctgctgagctgagctggggcgcggctgcctgtctgcaccggcagcaccatgtcgctcatggtcgtcagcatggcgtgtgttgggttcttcttgctgcagggggcctggacacatgagggtggtcaggacaagcccttgctgtctgcctggcccagcactgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgccagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagacttctgtcagtcagcagtgaaacttataaaattttttgtgatttcaatgtagctgtctccttttcaaataaacatgtctgccctc

SEQ ID NO: 146476 - DNA, 1596 bp, Homo sapiens
  Payload ID: 8981
  Gene Symbol: KIR2DL5B
  Gene Name: killer cell immunoglobulin-like receptor, two domains, long cytoplasmic tail, 5B
  ENST ID: ENST00000614018
  CDS Start-End: 56-1183
ctgtgcgctgctgagctgagctggggcgcggctgcctgtctgcaccggcagcaccatgtcgctcatggtcgtcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctc

SEQ ID NO: 146477 - DNA, 1109 bp, Homo sapiens
  Payload ID: 8982
  Gene Symbol: KIR2DP1
  Gene Name: killer cell immunoglobulin-like receptor, two domains, pseudogene 1
  ENST ID: ENST00000613362
  CDS Start-End: 1-915
atgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaacc

SEQ ID NO: 146478 - DNA, 1494 bp, Homo sapiens
  Payload ID: 8982
  Gene Symbol: KIR2DP1
  Gene Name: killer cell immunoglobulin-like receptor, two domains, pseudogene 1
  ENST ID: ENST00000620286
  CDS Start-End: 26-1390
gccgcctgtctgcaccggcagcaccatgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcagttttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcagctcccagtgaccctctggacatcgtggtcgtaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccagcaccacagtcaggccttgaggggatcttctagggagacaacagccctgtctcaaaaccgggttgccagctcccatgtaccagcagctggaatctgaaggcgtgagtctgcatcttagggcatcgctcttcctcaca

SEQ ID NO: 146479 - DNA, 1410 bp, Homo sapiens
  Payload ID: 8982
  Gene Symbol: KIR2DP1
  Gene Name: killer cell immunoglobulin-like receptor, two domains, pseudogene 1
  ENST ID: ENST00000622004
  CDS Start-End: 39-953
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactca

SEQ ID NO: 146480 - DNA, 1601 bp, Homo sapiens; identical to SEQ ID NO: 146336
  Payload ID: 8982
  Gene Symbol: KIR2DP1
  Gene Name: killer cell immunoglobulin-like receptor, two domains, pseudogene 1
  ENST ID: ENST00000618023
  CDS Start-End: 39-1088

SEQ ID NO: 146481 - DNA, 1570 bp, Homo sapiens
  Payload ID: 8982
  Gene Symbol: KIR2DP1
  Gene Name: killer cell immunoglobulin-like receptor, two domains, pseudogene 1
  ENST ID: ENST00000611070
  CDS Start-End: 1-1368
atgtcgctcatggtcgtcagcatggcgtgtgttgggttcttcttgctggaggggccctggccacatgtgggtggtcaggacaagcccttcctctctgcctggcccggcactgtggtgtctgaaggacaacatgtgactcttcagtgtcgctctcgtcttgggtttaaagaattcagtctgtccaaagaagacgggatgcctgtccctgagctctacaacagaatattccggaacagctttctcatgggccctgtgaccccagcacatgcagggacctacagatgttgcagttcacacccacactcccccactgggtggtcggcacccagcaaccctgtggtgatcatggtcacaggagtccacagaaaaccttccctcctggcccacccaggtcccctggtgaaatcgggagagacggtcatcctgcaatgttggtcagatgtcagttttgagcgcttccttctgcacagagaggggatcactgaggaccccttgcgcctcgttggacagctccacgatgcgggttcccaggtcaactattccatgggtcccatgacacctgcccttgcagggacctacagatgctttggttctgtcactcacttaccctatgagttgtcagctcccagtgaccctctggacatcgtggtcgtaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattct

SEQ ID NO: 146482 - DNA, 1596 bp, Homo sapiens
  Payload ID: 8982
  Gene Symbol: KIR2DP1
  Gene Name: killer cell immunoglobulin-like receptor, two domains, pseudogene 1
  ENST ID: ENST00000621698
  CDS Start-End: 38-1087
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaaagttgtctcctgcccatgagcaccacagtcaggccttgaggggatcttctagggagacaacagccctgtctcaaaaccgggttgccagctcccatgtaccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctca

SEQ ID NO: 146483 - DNA, 1102 bp, Homo sapiens
  Payload ID: 8982
  Gene Symbol: KIR2DP1
  Gene Name: killer cell immunoglobulin-like receptor, two domains, pseudogene 1
  ENST ID: ENST00000621887
  CDS Start-End: 3-1019
ccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatctt

SEQ ID NO: 146484 - DNA, 1101 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000622039
  CDS Start-End: 14-928
caccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggaga

SEQ ID NO: 146485 - DNA, 1384 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000622218
  CDS Start-End: 39-953
gagctggggcgcagccgcctgtctgcaccggcagcaccatgtcgctcatggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctg

SEQ ID NO: 146486 - DNA, 1577 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000615190
  CDS Start-End: 41-955
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctc

SEQ ID NO: 146487 - DNA, 1323 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000616491
  CDS Start-End: 41-955
ctgagctcggtcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaatt

SEQ ID NO: 146488 - DNA, 1372 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000621135
  CDS Start-End: 31-1077
tcgcggctgcctgtctgctccggcagcaccatgtcgctcttggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacct

SEQ ID NO: 146489 - DNA, 1630 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000612447
  CDS Start-End: 90-1004
tgtaaactgcatgggcagggcgccaaataacatcctgtgcgctgctgagctgagctggggcgcggccgcctgtctgcaccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146490 - DNA, 1101 bp, Homo sapiens; identical to SEQ ID NO: 146484
  Payload ID: 8983
  Gene Symbol: KIR2DS1
  Gene Name: killer cell immunoglobulin-like receptor, two domains, short cytoplasmic tail, 1
  ENST ID: ENST00000621207
  CDS Start-End: 14-928

SEQ ID NO: 146491 - DNA, 1557 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000611996
  CDS Start-End: 20-934
tgtctgcaccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 146492 - DNA, 1323 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000618071
  CDS Start-End: 41-955
ctgagctggggcgcggccgcctgtctgcaccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaatt

SEQ ID NO: 146493 - DNA, 1015 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000617661
  CDS Start-End: 12-926
ccggcagcaccatgtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacataga

SEQ ID NO: 146494 - DNA, 1535 bp, Homo sapiens
  Payload ID: 8983
  Gene Symbol: KIR2DS1
  Gene Name: killer cell immunoglobulin-like receptor, two domains, short cytoplasmic tail, 1
  ENST ID: ENST00000613951
  CDS Start-End: 20-913
gtcgctcacggtcgtcagcatggcgtgtgttgggttcttcttgctgcagggggcctggccacatgagggagtccacagaaaaccttccctcctggcccacccaggtcgcctggtgaaatcagaagagacagtcatcctgcaatgttggtcagatgtcatgtttgaacacttccttctgcacagagaggggatgtttaacgacactttgcgcctcattggagaacaccatgatggggtctccaaggccaacttctccatcagtcgcatgaagcaagacctggcagggacctacagatgctacggttctgttactcactccccctatcagttgtcagctcccagtgaccctctggacatcgtgatcataggtctatatgagaaaccttctctctcagcccagccgggccccacggttctggcaggagagaatgtgaccttgtcctgcagctcccggagctcctatgacatgtaccatctatccagggaaggggaggcccatgaacgtaggctccctgcagggaccaaggtcaacggaacattccaggccaactttcctctgggccctgccacccatggagggacctacagatgcttcggctctttccgtgactctccatacgagtggtcaaagtcaagtgacccactgcttgtttctgtcacaggaaacccttcaaatagttggccttcacccactgaaccaagctccgaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctc

SEQ ID NO: 146495 - DNA, 1579 bp, Homo sapiens
  Payload ID: 8984
  Gene Symbol: KIR2DS2
  Gene Name: killer cell immunoglobulin-like receptor, two domains, short cytoplasmic tail, 2
  ENST ID: ENST00000614622
  CDS Start-End: 90-953
tgtaaactgcatgggcagggcgccaaataacatcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146496 - DNA, 1557 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000617984
  CDS Start-End: 20-934
tgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 146497 - DNA, 1557 bp, Homo sapiens; identical to SEQ ID NO: 146496
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000617284
  CDS Start-End: 20-934

SEQ ID NO: 146498 - DNA, 1557 bp, Homo sapiens; identical to SEQ ID NO: 146496
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000612182
  CDS Start-End: 20-934

SEQ ID NO: 146499 - DNA, 1569 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000618510
  CDS Start-End: 32-946
ggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 146500 - DNA, 1558 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000617419
  CDS Start-End: 1-915
atgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagaaaaaacacactcctttgcttagcccacagttctccatttcacttgacccctgcccacctctccaacctaactggcttacttcctagtctacttgaggctgcaatcacactgaggaactcacaattccaaacatacaagaggctccctcttaacgcagcacttagacacgtgttgttccaccttccctcatgctgttccacctcccctcagactagctttcagtcttctgtcagcagtaaaacttatatattttttaaaataacttcaatgtagttttccatccttcaaataaacatgtctgccccc

SEQ ID NO: 146501 - DNA, 1058 bp, Homo sapiens
  Payload ID: 8984
  Gene Symbol: KIR2DS2
  Gene Name: killer cell immunoglobulin-like receptor, two domains, short cytoplasmic tail, 2
  ENST ID: ENST00000622343
  CDS Start-End: 1-864
atgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaacc

SEQ ID NO: 146502 - DNA, 1344 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000622127
  CDS Start-End: 90-1004
tgtaaactgcatgggcagggcgccaaataacatcctgtgcgctgctgagctgagctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146503 - DNA, 1397 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000616472
  CDS Start-End: 32-946
ggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgagg

SEQ ID NO: 146504 - DNA, 1381 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000613378
  CDS Start-End: 11-925
agacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactc

SEQ ID NO: 146505 - DNA, 1465 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000614231
  CDS Start-End: 32-946
ggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcacttagacacgtgctgttccacct

SEQ ID NO: 146506 - DNA, 1381 bp, Homo sapiens; identical to SEQ ID NO: 146504
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000614727
  CDS Start-End: 11-925

SEQ ID NO: 146507 - DNA, 1569 bp, Homo sapiens; identical to SEQ ID NO: 146499
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000618364
  CDS Start-End: 32-946

SEQ ID NO: 146508 - DNA, 1123 bp, Homo sapiens
  Payload ID: 8984
  Gene Symbol: KIR2DS2
  Gene Name: killer cell immunoglobulin-like receptor, two domains, short cytoplasmic tail, 2
  ENST ID: ENST00000613952
  CDS Start-End: 12-626
cagacagcaccatgtcgctcatggtcgtcagcatggcgtgtgttgggttcttcttgctgcagggggcctggccacatgagggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactagcttacttcctagtctacctgaggctgcaatcacactgaggaactcacaattccaaacatacaagaggctccctcttaacacagcac

SEQ ID NO: 146509 - DNA, 1286 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000611495
  CDS Start-End: 32-946
ggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146510 - DNA, 1579 bp, Homo sapiens; identical to SEQ ID NO: 146495
  Payload ID: 8984
  Gene Symbol: KIR2DS2
  Gene Name: killer cell immunoglobulin-like receptor, two domains, short cytoplasmic tail, 2
  ENST ID: ENST00000616523
  CDS Start-End: 90-953

SEQ ID NO: 146511 - DNA, 1169 bp, Homo sapiens
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000610441
  CDS Start-End: 3-917
ccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagagaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatctta

SEQ ID NO: 146512 - DNA, 1169 bp, Homo sapiens; identical to SEQ ID NO: 146511
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000619473
  CDS Start-End: 3-917

SEQ ID NO: 146513 - DNA, 1558 bp, Homo sapiens; identical to SEQ ID NO: 146500
  Payload ID: 8984
  Gene Symbol: KIR2DS2
  Gene Name: killer cell immunoglobulin-like receptor, two domains, short cytoplasmic tail, 2
  Uniprot ID: P43631
  ENST ID: ENST00000616541
  CDS Start-End: 1-915

SEQ ID NO: 146514 - DNA, 991 bp, Homo sapiens
  Payload ID: 8985
  Gene Symbol: KIR2DS3
  Gene Name: killer cell immunoglobulin-like receptor, two domains, short cytoplasmic tail, 3
  Uniprot ID: Q14952
  ENST ID: ENST00000611193
  CDS Start-End: 60-974
atcctgtgcgctgctgagctgagctaggggtgcggccgcctgtctgctccggcaccaccatgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccgacaaaaaaaatgcatctgtaatggaccaagggcctgcggggaacagaacagtgaacagggaggattctgatgaacaggaccatcaggaggtgtcatacgcataattggatcactgtgtttt

SEQ ID NO: 146515 - DNA, 1216 bp, Homo sapiens
  Payload ID: 8985
  Gene Symbol: KIR2DS3
  Gene Name: killer cell immunoglobulin-like receptor, two domains, short cytoplasmic tail, 3
  ENST ID: ENST00000617330
  CDS Start-End: 60-974
atcctgtgcgctgctgagctgagctaggggtgcggccgcctgtctgctccggcaccaccatgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagt

SEQ ID NO: 146516 - DNA, 1193 bp, Homo sapiens
  Payload ID: 8985
  Gene Symbol: KIR2DS3
  Gene Name: killer cell immunoglobulin-like receptor, two domains, short cytoplasmic tail, 3
  Uniprot ID: Q14952
  ENST ID: ENST00000613265
  CDS Start-End: 37-951
ctaggggtgcggccgcctgtctgctccggcaccaccatgtcgctcatggtcatcagcatggcatgtgttgggttcttctggctgcagggggcctggccacatgagggattccgcagaaaaccttccctcctggcccacccaggtcgcctggtgaaatcagaagagacagtcatcctgcaatgttggtcagatgtcatgtttgagcacttccttctgcacagagaggggacgtttaacgacactttgcgcctcattggagagcacattgatggggtctccaaggccaacttctccatcggtcgcatgaggcaagacctggcagggacctacagatgctacggttctgttcctcactccccctatcagttttcagctcccagtgaccctctggacatcgtgatcacaggtctatatgagaaaccttctctctcagcccagccgggccccacggttctggcaggagagagcgtgaccttgtcctgcagctcctggagctcctatgacatgtaccatctatccacggagggggaggcccatgaacgtaggttctctgcagggcccaaggtcaacggaacattccaggccgactttcctctgggccctgccacccaaggaggaacctacagatgcttcggctctttccatgactctccctacgagtggtcaaagtcaagtgacccactgcttgtttctgtcacaggaaacccttcaaatagttggccttcacccactgaaccaagctccaaaaccggtaaccccagacacctacacgttctgattgggacctcagtggtcaaactccctttcaccatcctcctcttctttctccttcatcgctggtgctccgacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagatagcagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagt

SEQ ID NO: 146517 - DNA, 1193 bp, Homo sapiens; identical to SEQ ID NO: 139181
  Payload ID: 8985
  Gene Symbol: KIR2DS3
  Gene Name: killer cell immunoglobulin-like receptor, two domains, short cytoplasmic tail, 3
  ENST ID: ENST00000614513
  CDS Start-End: 37-951

SEQ ID NO: 146518 - DNA, 1193 bp, Homo sapiens; identical to SEQ ID NO: 146516
  Payload ID: 8985
  Gene Symbol: KIR2DS3
  Gene Name: killer cell immunoglobulin-like receptor, two domains, short cytoplasmic tail, 3
  Uniprot ID: Q14952
  ENST ID: ENST00000614725
  CDS Start-End: 37-951

SEQ ID NO: 146519 - DNA, 1608 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000339924
  CDS Start-End: 90-982
tgtaaactgcatgggcagggcgccaaataacatcctgtgcgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146520 - DNA, 677 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000391729
  CDS Start-End: 1-677
atgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggtaaccccagacacctacatgttctgattgggacc

SEQ ID NO: 146521 - DNA, 1410 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000617469
  CDS Start-End: 39-953
gagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcacccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactca

SEQ ID NO: 146522 - DNA, 1344 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000619771
  CDS Start-End: 90-1004
tgtaaactgcatgggcagggcgccaaataacatcctgtgtgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146523 - DNA, 1295 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000616914
  CDS Start-End: 47-939
gctgagctgagctggggcgcggccgcctgtctgcaccggcagcaccatgtcgctcatggtcatcatcatggcgtgtgttgggttcttcttgctgcagggggcctggccacaggaggaagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttactcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgct

SEQ ID NO: 146524 - DNA, 1256 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000621991
  CDS Start-End: 8-900
cagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggagggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgct

SEQ ID NO: 146525 - DNA, 677 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000619816
  CDS Start-End: 1-677
atgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggagggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggtaaccccagacacctacatgttctgattgggacc

SEQ ID NO: 146526 - DNA, 1240 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000621713
  CDS Start-End: 8-900
cagcaccatgtcgctcatggtcatcatcatggcgtgtgttgggttcttcttgctgcagggggcctggccacaggaggaagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttactcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146527 - DNA, 1112 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000611873
  CDS Start-End: 12-904
ccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcc

SEQ ID NO: 146528 - DNA, 1563 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000615996
  CDS Start-End: 47-1171
gctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggagggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcat

SEQ ID NO: 146529 - DNA, 1574 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000617550
  CDS Start-End: 56-775
ctgtgcgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146530 - DNA, 1630 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000621436
  CDS Start-End: 90-1004
tgtaaactgcatgggcagggcgccaaataacatcctgtgtgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146531 - DNA, 1344 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000620669
  CDS Start-End: 90-1004
tgtaaactgcatgggcagggcgccaaataacatcctgtgcgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146532 - DNA, 1315 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000610558
  CDS Start-End: 1-516
actttgcacctcattggagagcaccatgatggggtttccaaggccaacttctccattggtcccatgatgcctgtccttgcaggaacctacagatgctacggttctgttactcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146533 - DNA, 900 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000619141
  CDS Start-End: 8-900
cagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacagttctgttcctcactccccctatcagttgtcagctcccagtgaccctctggacatggtgatcataggtctatatgagaaaccttctctctcagcccagccgggccccacggttcaggcaggagagaatgtgtccttgtcctgcagctccatctatccagggagggggaggcccatgaacgtaggctccctgcagtgcgcagcatccacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataa

SEQ ID NO: 146534 - DNA, 1850 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000617783
  CDS Start-End: 31-1227
gcgcggccgcctgtctgcaccggcagcaccatgtcgctcatggtcatcatcatggcgtgtgttgggttcttcttgctgcagggggcctggccacaggagggtggtcaggacaagcccttgctttctacctggcccagccttgtggtgcctccagaacatgtgactcttcagtgtcactctaatcttgggtttaacaacttcagtctgtacaaggatgatggggtgcctgtccctgagctgtacaacagaatattctggaaaagccttttcatgggccctgtgaccccgtcacatgcagggacctatagatgccggggttcacacacacactcccccagtgggtggtcggcacccagcaaccccctggtgatcatggtcacaggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctca

SEQ ID NO: 146535 - DNA, 1322 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000613379
  CDS Start-End: 90-1214
tgtaaactgcatgggcagggcgccaaataacatcctgtgcgctgctgagctgagctggggcgcggccgcctgtctgcaccggcagcaccatgtcgctcatggtcatcatcatggcgtgtgttgggttcttcttgctgcagggggcctggccacaggaggaagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttactcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146536 - DNA, 1633 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000614639
  CDS Start-End: 99-1004
tgtaaactgcatgggcagggcgccaaataacatcctgtgtgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatggttt

SEQ ID NO: 146537 - DNA, 1322 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000610808
  CDS Start-End: 90-981
tgtaaactgcatgggcagggcgccaaataacatcctgtgcgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaa

SEQ ID NO: 146538 - DNA, 1630 bp, Homo sapiens; identical to SEQ ID NO: 146530
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000612783
  CDS Start-End: 90-1004

SEQ ID NO: 146539 - DNA, 1596 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000613654
  CDS Start-End: 56-970
ctgtgtgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgg

SEQ ID NO: 146540 - DNA, 1630 bp, Homo sapiens; identical to SEQ ID NO: 146530
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000617825
  CDS Start-End: 90-1004

SEQ ID NO: 146541 - DNA, 677 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000621830
  CDS Start-End: 1-677
atgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacagttctgttcctcactccccctatcagttgtcagctcccagtgaccctctggacatggtgatcataggtctatatgagaaaccttctctctcagcccagccgggccccacggttcaggcaggagagaatgtgtccttgtcctgcagctccatctatccagggagggggaggcccatgaacgtaggctccctgcagtgcgcagcatccacggaacattccaggccgactttcctctgggccctgccacccacggagggacctacagatgcttcggctctttccgtgacgctccctacgagtggtcaaactcgagtgatccactgcttgtttccgtcacaggtaaccccagacacctacatgttctgattgggacc

SEQ ID NO: 146542 - DNA, 1295 bp, Homo sapiens
  Payload ID: 8986
  Gene Symbol: KIR2DS4
  Gene Name: killer cell immunoglobulin-like receptor, two domains, short cytoplasmic tail, 4
  ENST ID: ENST00000615270
  CDS Start-End: 47-938
gctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgctttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgct

SEQ ID NO: 146543 - DNA, 1630 bp, Homo sapiens
  Payload ID: 8986
  Gene Symbol: KIR2DS4
  Gene Name: killer cell immunoglobulin-like receptor, two domains, short cytoplasmic tail, 4
  Uniprot ID: P43632
  ENST ID: ENST00000611311
  CDS Start-End: 90-1004
tgtaaactgcatgggcagggcgccaaataacatcctgtgcgctgctgagctgagctggggcgcggccgcctgtctgcaccggcagcaccatgtcgctcatggtcatcatcatggcgtgtgttgggttcttcttgctgcagggggcctggccacaggagggagtccacagaaaaccttccttcctggccctcccaggtcacctggtgaaatcagaagagacagtcatcctgcaatgttggtcggatgtcatgtttgagcacttccttctgcacagagaggggaagtttaacaacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcagcatcaacggaacattccaggccgactttcctctgggccctgccacccacggagggacctacagatgcttcggctctttccgtgacgctccctacgagtggtcaaactcgagtgatccactgcttgtttccgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacaggtgctgttccacctcccttcagactatctttcagccttctgccagcagtaaaacttataaattttttaaataatttcaatgtagttttcccgccttcaaataaacatgtctgccctcatgg

SEQ ID NO: 146544 - DNA, 1120 bp, Homo sapiens
  Payload ID: 8987
  Gene Symbol: KIR2DS5
  Gene Name: killer cell immunoglobulin-like receptor, two domains, short cytoplasmic tail, 5
  ENST ID: ENST00000615980
  CDS Start-End: 59-973
tcctgtgcgctgctgagctgagctaggggtgcggccgcctgtctgctccggcaccaccatgtcactcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacggaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccaaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtca

SEQ ID NO: 146545 - DNA, 1422 bp, Homo sapiens
  Payload ID: 8987
  Gene Symbol: KIR2DS5
  Gene Name: killer cell immunoglobulin-like receptor, two domains, short cytoplasmic tail, 5
  ENST ID: ENST00000619788
  CDS Start-End: 57-971
ctgtgcgctgctgagctgagctaggggtgcggccgcctgtctgctccggcaccaccatgtcactcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgttctgcagctcccggagctcctatgacatgtaccatctatccagggaaggggaggcccatgaacgtaggctccctgcagggcccaaggtcaacggaacattccaggccgactttcctctggaccctgccacccacggagggacctacagatgcttcggctctttccatgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgagg

SEQ ID NO: 146546 - DNA, 1601 bp, Homo sapiens
  Payload ID: 8987
  Gene Symbol: KIR2DS5
  Gene Name: killer cell immunoglobulin-like receptor, two domains, short cytoplasmic tail, 5
  ENST ID: ENST00000614053
  CDS Start-End: 35-949
aggggtgcggccgcctgtctgcaccggcagcaccatgtcgctcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacagaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcaaaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacagcacttagacacgtgctgttccaccttctctcatgcagttccacctcccctcagactatctttcagccttctgtcagcagtaaaacttataaattgtttttagtaatttcaatgtagttttccctccttcaaataaacatgtctgccctcatggtttcg

SEQ ID NO: 146547 - DNA, 1455 bp, Homo sapiens
  Payload ID: 8987
  Gene Symbol: KIR2DS5
  Gene Name: killer cell immunoglobulin-like receptor, two domains, short cytoplasmic tail, 5
  ENST ID: ENST00000619698
  CDS Start-End: 12-926
ccggcagcaccatgtcgctcatggtcatcagcatggcgtgtgttgcgttcttcttgctgcagggggcctggccacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacagaacattccaggccgactttcctctggaccctgccacccacggagggacctacagatgcttcggctctttccgtgactctccatacgagtggtcaaagtcaagtgacccactgcttgtttctgtcacaggaaactcttcaaatagttggccttcacccactgaaccaagctccgaaaccggtaaccccagacacctacacgttctgattgggacctcagtggtcaaactccctttcaccatcctcctcttctttctccttcatcgctggtgctccaacaaaaaaaatgcatctgtaatggaccaagggcctgcggggaacagaacagtgaacagggaggattctgatgaacaggaccatcaggaggtgtcatacgcataattggatcactgtgttttcacacagagaaaaatcactcccccttctcagaggcccaagacacccccaacagataccagcatgtacatagaacttccaaatgctgagtccagatccaaagctgtcttctgtccacgagcaccacagtcaggccttgaggggatcttctagggagacaacagccctgtctcaaaaccgggttgccagctcccatgtaccagcagctggaatctgaaggcatcagtcttcatcttaggggatcgctcttcctcaaaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacagcacttagacacgtgctgttccaccttctctcatgc

SEQ ID NO: 146548 - DNA, 1601 bp, Homo sapiens
  Payload ID: 8987
  Gene Symbol: KIR2DS5
  Gene Name: killer cell immunoglobulin-like receptor, two domains, short cytoplasmic tail, 5
  ENST ID: ENST00000617536
  CDS Start-End: 39-1088
gagctggggcgcggctgcctgtctgcaccggcagcaccatgtcgctcatggtcgtcagcatggcgtgtgttgggttcttcttgctgcagggggcctggacacatgagggattccgcagaaaaccttccctcctggcccacccaggtcccctggtgaaatcagaagagacagtcatcctgcaatgttggtcagatgtcatgtttgagcacttccttctgcacagagaggggacgtttaaccacactttgcgcctcattggagagcacattgatggggtctccaagggcaacttctccatcggtcgcatgacacaagacctggcagggacctacagatgctacggttctgttactcactccccctatcagttgtcagcgcccagtgaccctctggacatcgtgatcacaggtctatatgagaaaccttctctctcagcccagccgggccccacggttctggcaggagagagcgtgaccttgtcctgcagctcccggagctcctatgacatgtaccatctatccagggaaggggaggcccatgaacgtaggctccctgcagggcccaaggtcaacggaacattccaggccgactttcctctggaccctgccacccacggagggacctacagatgcttcggctctttccgtgactctccatacgagtggtcaaagtcaagtgacccactgcttgtttctgtcacaggaaacccttcaaatagttggccttcacccactgaaccaagctccaaaaccggtaacccaagacacctgcacgttctgattgggacctcagtggtcatcatcctcttcatcctcctcctcttctttctccttcatcgctggtgctccaacaagaaaaatgctgctgtaatggaccaagagcctgcagggaacagaacagcgaatagcgaggactctgatgaacaagaccctcaggaggtgacatacgtacagttggatcactgcgttttcacacagagaaaaatcactcgcccttctcagaggcccaagacacccccaacagataccagagtgtacacggaacttccaaatgctgagtccagatccaacgttgtctcctgcccatgagcaccacagtcaggccttgaggggatcttctagggagacaatagccctgtctcaaaaccgggttgccagctcccatgtgccagcagctggaatctgaaggcgtgagtctgcatcttagggcatcgctcttcctcacaccacaaatctgaatgtgcctctctcttgcttacaaatgtctaaggtccccactgcctgctggagagaaaacacactcctttgcttagcccacaattctccatttcacttgacccctgcccacctctccaaccttactggcttacttcctagtctacttgaggctgcaatcacactgaggaactcacagttccaaacatacaagaggctccctcttaacacggcacttagacacgtcctgttccaccttccctcatgctgttccacctcccctcagagtatctttcagccttctgtcagcagtaaaacttatatattttttaaaataatttcaatgtagttttccctccttcaaataaacatgtctgccctcatggt

SEQ ID NO: 146549 - DNA, 1601 bp, Homo sapiens; identical to SEQ ID NO: 146546
  Payload ID: 8987
  Gene Symbol: KIR2DS5
  Gene Name: killer cell immunoglobulin-like receptor, two domains, short cytoplasmic tail, 5
  ENST ID: ENST00000618443
  CDS Start-End: 35-949

SEQ ID NO: 146550 - DNA, 1448 bp, Homo sapiens
  Payload ID: 8988
  Gene Symbol: KLRB1
  Gene Name: killer cell lectin-like receptor subfamily B, member 1
  Uniprot ID: Q12918
  ENST ID: ENST00000229402
  CDS Start-End: 48-725
gagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccacatttagtggcacaaagtgaacaattctgagaattgacaactgttatgaatcttacagaagttcatgtttatcatattcattctattaaatgaggaaacagagacatagagaaaaacgtgcatcgttttaaagaaacagtgatattctatggtgaaggagtgaaggatgtccccgaatatgccagattggtatatgattgttttgtgtttaaaacagtggagaaattgtagattcagaaagggagagctgacctgtctcttcccgcacgcggcaagccgtgaagattcctctgggagggctatccgagtcatacaagggcaagaaaatagctcttatcgccagagacctggaattggatgctgcaatgaacctgaataaagatacttaataaacacctatctttcacctattttacagccccccgcaaccaatatatctcctagtgactcctctagaaaatttattgcccctagccagcttttcttcatcctgtcatttcttttcaaatttatcattcttggtctaaaaagcataaaagcatcttgcttaggccacttctatggatttcactctcttgcgagttcctcatgtacatgcaaaacgaataaaatgtgtatacttttattttgttca

SEQ ID NO: 146551 - DNA, 1332 bp, Homo sapiens
  Payload ID: 8989
  Gene Symbol: KLRC1
  Gene Name: killer cell lectin-like receptor subfamily C, member 1
  Uniprot ID: P26715
  ENST ID: ENST00000347831
  CDS Start-End: 165-812
gcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaa

SEQ ID NO: 146552 - DNA, 1407 bp, Homo sapiens
  Payload ID: 8989
  Gene Symbol: KLRC1
  Gene Name: killer cell lectin-like receptor subfamily C, member 1
  Uniprot ID: P26715
  ENST ID: ENST00000359151
  CDS Start-End: 183-884
gggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaaaaa

SEQ ID NO: 146553 - DNA, 1559 bp, Homo sapiens
  Payload ID: 8989
  Gene Symbol: KLRC1
  Gene Name: killer cell lectin-like receptor subfamily C, member 1
  Uniprot ID: P26715
  ENST ID: ENST00000408006
  CDS Start-End: 389-1036
gcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccagaaaaaaaaaaaaa

SEQ ID NO: 146554 - DNA, 1600 bp, Homo sapiens
  Payload ID: 8989
  Gene Symbol: KLRC1
  Gene Name: killer cell lectin-like receptor subfamily C, member 1
  Uniprot ID: P26715
  ENST ID: ENST00000544822
  CDS Start-End: 389-1090
gcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatccag

SEQ ID NO: 146555 - DNA, 1179 bp, Homo sapiens
  Payload ID: 8989
  Gene Symbol: KLRC1
  Gene Name: killer cell lectin-like receptor subfamily C, member 1
  ENST ID: ENST00000536188
  CDS Start-End: 458-1144
acagttgagaggagtttgagtggagattcagggccattttagtatcttctgtaggacagaggtcagcaagcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttgctatagcaggcctttttatgagactaacctggcctctccactaaaggatgtgtgactttctggggacagaagagtacagtccctgacatcacacactgcagagatggataaccaaggagtaatctactcagacctgaatctgcccccaaacccaaagaggcagcaacgaaaacctaaaggcaataaaaactccattttagcaactgaacaggaaataacctatgcggaattaaaccttcaaaaagcttctcaggattttcaagggaatgacaaaacctatcactgcaaagatttaccatcagctccagagaagctcattgttgggatcctgggaattatctgtcttatcttaatggcctctgtggtaacgatagttgttattccctctacattaatacagaggcacaacaattcttccctgaatacaagaactcagaaagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagataaaagactcagataatgctgaacttaactgtgcagtgctacaagtaaatcgacttaaatcagcccagtgtggatcttcaataatatatcattaaacttgttaatttaatacaatttacaacacacctgc

SEQ ID NO: 146556 - DNA, 530 bp, Homo sapiens
  Payload ID: 8989
  Gene Symbol: KLRC1
  Gene Name: killer cell lectin-like receptor subfamily C, member 1
  ENST ID: ENST00000543893
  CDS Start-End: 1-233
aggagtggattacatattccaacagttgttactacattggtaaggaaagaagaacttgggaagagagtttgctggcctgtacttcgaagaactccagtctgctttctatagataatgaagaagaaatgaaatttctgtccatcatttcaccatcctcatggattggtgtgtttcgtaacagcagtcatcatccatgggtgacaatgaatggtttggctttcaaacatgagtaagttgttttgtatggcgctatataacaatatatatataaaggataaattcagaagaataatatgaataaatctatgtggaatcatagagatgaagaaagatgtggaaagttagtgaaatgctgacataaatattttacaatagaccatagtagtccatatatttcaaccgctcattggtcagctagtaaccttcttgattatcaggtgtccaatctttggcttctgtgggccacattggaagaagaagagtcttgggccacacataaaatacactaacactaacgatagctgacgagc

SEQ ID NO: 146557 - DNA, 1211 bp, Homo sapiens
  Payload ID: 8990
  Gene Symbol: KLRC2
  Gene Name: killer cell lectin-like receptor subfamily C, member 2
  ENST ID: ENST00000381901
  CDS Start-End: 8-703
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaattcttccccaaatacaagaacccagaaaacacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccag

SEQ ID NO: 146558 - DNA, 1221 bp, Homo sapiens
  Payload ID: 8990
  Gene Symbol: KLRC2
  Gene Name: killer cell lectin-like receptor subfamily C, member 2
  Uniprot ID: P26717
  ENST ID: ENST00000381902
  CDS Start-End: 8-703
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccagaaaaaaaaaa

SEQ ID NO: 146559 - DNA, 549 bp, Homo sapiens
  Payload ID: 8990
  Gene Symbol: KLRC2
  Gene Name: killer cell lectin-like receptor subfamily C, member 2
  ENST ID: ENST00000535069
  CDS Start-End: 1-312
aaaagctccatttcaggaaccgaacaggaaatattccaagtagaattaaatcttcaaaatccttccctgaatcatcaagggattgataaaatatatgactgccaaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattaaacttgttaatttaatacaattt

SEQ ID NO: 146560 - DNA, 771 bp, Homo sapiens
  Payload ID: 8990
  Gene Symbol: KLRC2
  Gene Name: killer cell lectin-like receptor subfamily C, member 2
  ENST ID: ENST00000536833
  CDS Start-End: 116-634
aaacttgttaatttaatacaatttacaacacacctgctggcactttgatctgggacctccctgttgtctgaactaggtaacctgacctctccactgaagggcgtgtggctttctgatgacagtaggtttactgccacctccagagaagctcactgccgaggtcctaggaatcatttgcattgtcctgatggccactgtgttaaaaacaatagttcttattcctttcctggagcagaacaatttttccccgaatacaagaacgcagaaagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaatag

SEQ ID NO: 146561 - DNA, 500 bp, Homo sapiens
  Payload ID: 8990
  Gene Symbol: KLRC2
  Gene Name: killer cell lectin-like receptor subfamily C, member 2
  ENST ID: ENST00000537017
  CDS Start-End: 1-257
catattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataatacatggaaaatgctttcgtctcatgaatcatttgcttaaaatgtaacagaaaatggatttttctccattacaggataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttat

SEQ ID NO: 146562 - DNA, 883 bp, Homo sapiens
  Payload ID: 8990
  Gene Symbol: KLRC2
  Gene Name: killer cell lectin-like receptor subfamily C, member 2
  ENST ID: ENST00000619500
  CDS Start-End: 1-375
atgataccaacacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatgaaatttctggccagcattttaccttcctcatggattggtgtgtttcgtaacagcagtcatcatccatgggtgacaataaatggtttggctttcaaacataagataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccag

SEQ ID NO: 146563 - DNA, 798 bp, Homo sapiens
  Payload ID: 8991
  Gene Symbol: KLRC3
  Gene Name: killer cell lectin-like receptor subfamily C, member 3
  Uniprot ID: Q07444
  ENST ID: ENST00000381903
  CDS Start-End: 1-774
atgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtttactgccacctccagaaaagctcactgccgaggtcctaggaatcatttgcattgtcctgatggccactgtgttaaaaacaatagttcttattcctttcctggagcagaacaattcttccccgaatgcaagaacccagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattgtgagcataagctttagaattaaagcgcttgagcttgcagtgcatcagataaaattttatatttgttcaaacagaaatgatattatgattgcataagccttaaaatgaattgtgttattt

SEQ ID NO: 146564 - DNA, 1028 bp, Homo sapiens
  Payload ID: 8991
  Gene Symbol: KLRC3
  Gene Name: killer cell lectin-like receptor subfamily C, member 3
  Uniprot ID: Q07444
  ENST ID: ENST00000396439
  CDS Start-End: 46-768
gcagttatcatagagcacagtccctcacatcacacagctgcagagatgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtttactgccacctccagaaaagctcactgccgaggtcctaggaatcatttgcattgtcctgatggccactgtgttaaaaacaatagttcttattcctttcctggagcagaacaattcttccccgaatgcaagaacccagaaagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatgaacaatataa

SEQ ID NO: 146565 - DNA, 930 bp, Homo sapiens
  Payload ID: 8992
  Gene Symbol: KLRC4
  Gene Name: killer cell lectin-like receptor subfamily C, member 4
  Uniprot ID: O43908
  ENST ID: ENST00000309384
  CDS Start-End: 183-659
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaagc

SEQ ID NO: 146566 - DNA, 3165 bp, Homo sapiens
  Payload ID: 8993
  Gene Symbol: KLRD1
  Gene Name: killer cell lectin-like receptor subfamily D, member 1
  Uniprot ID: Q13241
  ENST ID: ENST00000350274
  CDS Start-End: 261-707
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 146567 - DNA, 3258 bp, Homo sapiens
  Payload ID: 8993
  Gene Symbol: KLRD1
  Gene Name: killer cell lectin-like receptor subfamily D, member 1
  Uniprot ID: Q13241
  ENST ID: ENST00000336164
  CDS Start-End: 261-800
ctgtattgtggttcctggaacacttcagaggcttgtgattctactgcttcttattcacactataatacatgtctcaccaatagatgattcaagaacatcatttaaatacacaatttttcattctctatttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgca

SEQ ID NO: 146568 - DNA, 703 bp, Homo sapiens
  Payload ID: 8993
  Gene Symbol: KLRD1
  Gene Name: killer cell lectin-like receptor subfamily D, member 1
  ENST ID: ENST00000344825
  CDS Start-End: 129-347
gctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagcaggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacct

SEQ ID NO: 146569 - DNA, 15549 bp, Homo sapiens
  Payload ID: 8993
  Gene Symbol: KLRD1
  Gene Name: killer cell lectin-like receptor subfamily D, member 1
  Uniprot ID: Q13241
  ENST ID: ENST00000381908
  CDS Start-End: 203-742
gttttgctcttgtcacccaggctggagtgcaatggtgcgatctcagctcatcaagttcaagagactctaatgcctcagcctcccaagtagcaggggttacagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacctacatttgagaattataaaattaacataaagaattttgtattttcatttaatgtatatatttaatgttaaattcaatgtagttttattacacatttatgtaattttatttacattcttgctaattctcagcagaaatttaaataagatttaattcacatcaaataaaatttagaaaataaaatttaactcacactgcccaggctggagcatagtggcaagatcatagctcattgcaagctcaagtgatcctcctgactcagcctcccaagtagctaggactgcaggcaccatgtcactatgcccgactaatttttaatttttaattttttgtcaagacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataatacaggcaagcatgtaatgattatcaatatttttttccaccaactatcctatacccctgacctcctttcattaggcattatcttctgttttgattttaacacttagagtggttttctctgttatgaatcaaagctgatctattttcatcatttttgtgatgaaaaaattaattttgattgacttaggatggaaggatttggactgggtgtggtggtttatgcctgtaatcgcagcactttgggaggccaaggcgggtggatcacttgaggtcaggagtttgagaccagcctggccaacatggtgaaaccctgtctctactaaaaatacaaaaattggctgggtgtggtagtgcacacctgtaatcccagctatttgggaggctgagtcgagaggatcgcttgaacctaggaggtggaggttgcagtgagtcgagattgcaccactgcactccagcctgggtgacagagccagactcctctccaaaaaaaaaaaaaaaaaaaaaagatgaaaggatttggaaccttaattgcatctgaaaaactgcctcacctttgttatttagtgtactccaaccacggagtaacatcccatcataatcccaaatcctactcaaacaaaaggggaagggattatgcaggtgtacactaggccactggtgtaccaattagaaaccactttagagttatgcctactgtacccacataatcctaaaaatatgttacaactgctacttcatagtttatgccacttattttattttttacttttattatttttttttctgagacacggtttcattcccattgcccaggctgtagtgcaatgatgcaatcatggttcactgcagcttcaacttcccaggctcaagggatcctcccacctcagccttctgagtacttgggactcaggtgcgagccatcatgctcagctaattttttgtatcatttgtagaaatggggttttgtattgttgcccaggctgatcttgaactcctggggtcaaggattctgcccgccttggcctcctaaagggctggaattacaggcataagccactgtgcccggccagtttatataatttaaacactgccttttggttccttgattcccatatgctaggacaagtaattattattttattttattttactttaagttctgggttacatgtgcagaacctgcaggtttgttacataggtatacatgttccaaggtggtttgctgcacctattgacccatcatctaggttttaagtcccacatgcattaggtatttgtcctaatgctcttcctccccttgccccccaccccccgacaggccttggtctgtgatgttcacctccctgtgtccatgtgttctcattgttcaactcccacttattagtaagaacatgtggtgtttggttttctgttcctgtgttagtttgctgagaatgatggtttccagcttcatccatgtcgctgcaaaggacatgaactcattctttttatggctgcatagtattccatggtgtatatgtgccatattttctttatccagtctatcactgatgggcatttgggttggttccaagtctttgctatggtaaatagtgctgcaataaacatacgtgtgcatgtgaggacaagtaattattttctgtttttctcaatacattaattattagttcctccgttagttgtgaagtcctaattagggaaaaggagttaggctggcgggagcagggaaaagcagaaagagaaagcagataagctatgagtctgcctttcttcatggtccaggatatgggccatgtgctaaactattaccagacacctgcaagttacctcaccgcaaccttggcattatcagtactggacaaagccctctgcagcatacagcataaacactattccataaaatcctaagcaagcctttgtttctttgcagtcagcttttcttctgctgatgctgcctgttgcctccctggaaacatattttcctacttttctttaataaatctgccttcctttacctacagctgtcttggtaaattcttttacctcaatgccaccggcccaggtagccgttgctcacccacaacattagtgtattagtccgttcttatgctgctactaaagatatacccaagactgggaaatttataaaataaagacatttaattgactcacagttctgcagggttggagaagcctcaggaaacttacagtaatgacagaagggaaagcaaacacatccctctacgcatggcagcagaaaggagacgtgctgagcaaaaggaaaaataccctcttattaaatcatcagatctagtgagaactcactcactatcatgagaacagcaaagaggtaactacccccatgattaaattacctcctaccagttccctcacatgatacgtgaggattaggggcactacaattcaagatgagatttgggtggggacacagccaagccatatcagttagtgacatctgtattctcatattgcatgcataagaaagtgagttattttacagctgaactgggacagctctttgcttatttccagagatgcctaggtgtctgtttttgactcttggccatgatatgggtagtaggctaactaactagctaacaaatggtttatggtgagttctttaaagttcaaaatccctcagtggaatccagggtcaatttgtttattgatagcttccatatgagataattacagatcttgtctctgctgtgtgaccagacacagataaaagactgcaagaaatttcagtttcagctctcatgaaaccaagtttcatctcacaaatatcaggtttcatccagagatgaatggtgtctttgcgcaaatatctcttggtcccacactgcttgtttgaattctctttctcatacggtatcatattcctttcacttattaaaaagtttttcatggctgggcgcggtggctcaagcctgtaatcccagcactttgggaggctgaggcgggtggatcacgaggtcaggagattgagaccatcctggctaacacggtgaaaccccgtgtgtactacaagtacaaaaaaattagccaggcgtggtgacaggcacctgtagtcccagctactcgggaggctgaggcaggagaatggcgagaacccgggagacggagtttacagtgagctgagatcgcgccactgcactccagcctgggtgacagaggagactccgtctccaaaaaaaaaaaaaaaaaaaaagcttttcataagtatgctcattagaaccttataattcatttcagttatctacacctggaaatgttagttctataattttggactttctgaaacttttctctttatatcctaacgcaggggttgaaaaacttttctcaaaaagctctatagcatatattttcaactttgtggaccagtctctgttgaaacttctcaaccttgccatggtggtgctaaagaagacataaataatacaaaaatgaatggtttgactgtgttacaaaagaattttattgacaaaacatatggtgagacagatttggtccacaggccatagtttgccaacatgtgcccaagtatgtaagatgagaatataaggccataaattctactctctgctttattcttttccaggtcacttcttaccagttgtaaatgtacttacaaattttgctatatgaaaacagttatgtctgttactatcaatctgtgttcattttaaagggtgacaatctacaaattatgtgttatagacaagttgcaagatgttcaccaatgattcccaccttgtgctatacatgccttggtggaatttctttccacattgtatcaaggttgctctgtgtgaccaatgaaataaagtggaaatgatgatatttcatttctgagaataggtcatcaaagatagtatgacttcctttttcctctctcccagattacttgatctggggaaaaccagttataatgtcatgagcagccctgttgaaaggaccatgcggcaaggaactgaagactcttacacacagccagcaaggaactgaagtctatttccaatagccatgctatgagccttctttgcttgtataggctccagtcttagtcaagccttcagatgattacagcccccagccaacaccttgacggcaacctcatgagagaccctgagctaggtccatcgtgctatgctgttcgaggattcctcactctcagaagctgtgtgaaatagtaaagtgtttattcttttttttttttttttttttgacagagtctcactctgtcacctgggctggagtgcagtggggccatgtcggctcactgcaacttctgcctcctggattcaagcaattctcctgcctcagcctcctgagcagctgggattacaggtgtgcaccaccactcctggctaatttttttgtatttttagtacagacggggtttcaccatgttggtcaggctggtcttgaactcctgacctcaggtgatctgcctacctcaccctcccaaagtgctgggattacaggcgtgagccactgcgcccagacataacttttattcttttaagtcactaaatattaacgtgtcacatagcaataatcaatacatattttggtaccaagaatgaagttactattataaagaaaaaaaaaaaccactaaaattttggagtgcttgaaaacaggcagtggatggaggccaaaaggacaggaaagactgaaaccttctagtatgggcttatagtagggaagtgaaaacatattagaaactggagaaagtaaaaatctttctatttagtaccagaaagtttagcaacacttttgtctgtagcattgtggaaagtagaaaatgtacttaatgatttaagagaatgctctaaacttatttccaactagagtgttgaatatcttgtctgatttcttcctactacttatattacaatgctatagaacacacataagctaatggaagggctgttgagcaaaagaagacagaacttgatagttttgagattcctggactctcaaatgttagcatgtcaaaaatgctaaaattgagaaatagattctgagcaaagatccaatctagagtgctctcaggaaagcatgattctaaacaagaaggtgtgggtgtgactgaaatttcctgtaaatatcatagaaagaacacaagtagtgcctcaattcagtcagatgaagatctataaaggtcaaataatagggcttctaggaagccccagggtattgtccctcaggtatctcagcagaagctccaggtagagagaagattgaagagatttatgtgtgcggtttttacaaatagagttcatagaaaacctcaaaacacttttgagatgactatgtcagtagaaaattgacaatgaattgctaccttttattcaaaagtaagaataattcaaaggacagaactaagagcctgtaaggtggatccaagagttatgaagagtgattttataagcagaaataggactgagtcctaatcaaatgagtcccgacatttgctatgctagattttaaattattatgcatcagtgactcctttgtaattctcatgcccctccctcttttgaacaaggatgtctatagtttgttctttcgaatgttgagtgtataagggaaggaaatctctagtattgttaatttcacaagccttcacatggagaaaaatgatactcaagaagctaaacttaaggaacttcacctgatgagtctcactcatacctggatgtgacaaatttcggactttgaactgacattgtaacggaatgagatttggcagttggtgtggattttgtatgtgggagggacataaatcatttggggccaaagattagactcttgtaaacagcttcctatatgctcccaatgatccctgtttcttggaatttaacccttttgatataatcaattacattgtataagggttgatcactgtgaccaagagaataaggcagaagttatcgcatatcacttttgaggctagattataaaagacagtatgtctttggcgttgccctttctcatatcatctgatttggtggaagccagctaccttgtcgtgagcaactcttttaagcgttccatgtggcaaagaactgaggcctcctataaacagctagcaaggaactgcagccatcttgtagacagccttgtgcacgagcctccttggttcaactcttcagccagtgtcaagccttagaaaatacaacccaacctacatttttactgcaacctcatgagggatcctgagctagaaccacctagcacagttgctcttgatttctgacctcagaaactgtgaagtgaaatattttgttgttttaagcttacgagtttgaggataatttgttctttatagtagttagctgatacaatatgcttcatcatcatgacctcatgaatagagaacatttatttatttattgagatggagtctcactctgtcacccaggctggagtgcagtggcacagtcttggctcactgcaacctctgcctcgctggttcaagcgattctcatgcctcagcctccccagtagctgggattacaggcacccaccaccatgcctggctaatttttgtattttcagtagacatgaggttttgccatgttggccaggctggtctccaactcctggcctcaagtgatccacctgcctcggcctcctgaagtgctgggattacaggcatgagccattgtgtctggccaaatagaggacattttagagcccaatagtaagctaggattatatttccttctttgaggttctattgttataacccttatacaataaaaaacaactcttctgccagattaaaattttttgttttttggtttttttagttctcaattatgttgtataacccatgagtgtcactttattctcattggaaatatcctcccaagagctcttacccacctgctgttgtttggactggcaccttactagacctgctccacaaactgccgtcatgaaatttttcttcactaattttctcatttacactaaatacttcattgattacagtttacctcttcatatattttaattgagcaaaaacacaataaagaatacctatcttaaatttactcgtaaacatttaagctatgtctacacttacacgattactaccagattgcaatagagactacctaccaccaccaagactctcttgctgtttgctaattgatactgtctcccctgttccaagaaaactgctactctgatttctgaaaatataggtttatttagcctgttctttaatttcatataaatggaagcttagcatgtatgatctttgtggcttctgttgctaagcattacgtctgtgagatacatccatatattcgtgcagcagtagctcctcacttttattgtcatgtagaattcataagaatgtatcacaatttgcttatttattctaatattgttcaacatttgagtcatttccacttttcactattatgagtaaaattgctataaacattttaatatagctcttgtgggacatgtggcttcatatcttttgagtgtacgcctaggagttgaatttctaagtcataagctgtcatatatttaggccctttagttcacgctttaaaaactagtgataatttattcataaagcttatttataatttcactggcagtttatgtgagtgttactctgtattcttgacaatacatagtattatgaattattttagtctaaggaccttctggatactatgcatttgcatacaattgtacatttaatttccatcttccaaatgaataatgatgcttatccctcatctttttttttcatttttatatccccttctatgtagtgcttgtttaagcttttagccattatttatttttaacagcgctgttgcagtataattgagatactttaagcatactttatatgcttaaagtatgacatttgatgtatttccatatctatgcatctgtgaaaccatcacctcagcaatatataaaacacctactaacctcaaaagtatcctttcccctatgtataaaatacttcctcttgctcctcccctcacagatgaatattctgttactatagatttgcctttctatgttttatatagatagaatcatataatatgtacatctgtgttctagatttttcattcagcatcataatagtttttatactcatctatgttgatacatgtatcaatagttaattcccttttatttcttatttctttcctttttttttttttttgagactgagtattgctctgtcacccagattagagtgcagtggtgtgatctcagctcactgcaaccttcaccacctgggttcaagttattctcatgcctcagcctccccagtagccgagattacagatgcccaccaccacgcccagctaatttttgtatttttagtagagacggggtttcaccatgttgaccagtcttgtcttgaactcctgacctcaactgctccacctgccttgacctcccaaagtgctggaattacaggcgtgagccaccacatccagccgattcctttttacttctgagagtcttctgatccttgagtaaagtatgtttcttgtacctcaatatgcttaattttttccttctggctttcgttttaggttcagggtatatatgtaggcttcttatatgagtacattgcatgttgcagtggtttggtgtacagataattttgtcatcctggtaatcagcatagtacctgacaggcagtttttctatcctcatccttctccctctcccccccaagtaggccccagtgtctattgtttcctttttttgtgtgcctgtgtactccatggttagctcccacttataagggagaatatgtggtttttggttttctgttcttccattgatttgcttaggataatggcctctagttctatccatgttcctgcaaaggacatgatttttttcttttttatgtctgcatagtattccatggtgtatatgtaccacattttctttacctagtccattgtctcaatatacttaagttatactcagtaatgttttgtagtttttaatattcaggccttttatgtttttatgagatttccccaaagtagtctattgtttttaaagctattatacattttattttctaatttcaaatgttttattttaaaattgtaagtatatatgtatatgtgtgtgtgtgtatatatatatatatatatatatattcatttacacagttgattctaagtgtatcttttattgtttaacctgcctaaattcacttatcctagcagcatttctgtagatttcattgggttatctgcatagatgaataaagacagtttttacctctttcttttgaaaactgtgtgcctttaattctttttatcaccttgtcacagtggccagaatattcaacacaaagttgaatacaagtggtgagtaaacacccttgttttgctattgatcttagagcatgaatattcactttttttacctttatacttaattttagctgtaggattttcataaatgacctttactaggttgagaaagttccctcctattcctagtctgatgagaatttttataaggagtacatatgacatatgcttttattaaatgttttattctgcctcgattgaaatcagatagtttttatttcccagttataaacctcagttgttcatgttatcttttttacgtatctttgcagatgctttgctaattttttaaaattttattttattgaggtaaatacaacataagatctatcctcttaacaaattttcaagtctacagtacagtattattaacaataggtacaatgttgtatagtagatctctataatttattcatcttgcataattgaggctttatgccctttgattaacgacgtcccattttttcctctctccattcctggcaaccaccattctattctctgattttataagcttgaccactttagatatttcacgtaagtggaatcatatagtatttatcctgtgacttgtttatttcatttagcataatgtcctcaagtttcatccacattgttacatattgcaggatttcatttttaaggctggataatattctattgtatgtgtatgtacacattggctactgtgactagtatagcaatggacagtagtatactaatatttctttgagattcttatttcaattcttttgcataattacccagaaaggggattggtggatcatatggtagttctatttttaattttttgagaaatcaccatcctgttttccacagaagcagcacaatttttcattcccaccaaagtgttcaaggggtctaattaccccacgtacttctcaacacttgtctttcatttgtttgataatagccatccttataagtgagagatgatatttggtggttataatttgcatttccctgatgattagtgatattgagcatcatttcatatgcccattgaccctttgtatgttttttatgaagaaatgaccattcaagtctttgatacattttttaattgggttacttgtgttttttttaatattgagttgtaggagttctttatatgttttggatattgactccttttctgatatatgatttgcaattattttctcccattctgtagatcatcctttcattccattggttatttcctttgtgaaccctgaaaatttgagacaggtctcagttaatttagaaagtttattttgcaaaggttgagaacatatgcccataacacagcctcacctcaggaggtcctgctgacatgtgcccaaggtggtcagggcacagtttggttttatacattttagggagacatgagacatcaatcaacatatgtaaaatgaacagtggtttggtctagaaaggtgggacaattcaaagcagaagtgaaacaactggaagcaaggagggggcttccaggtcacaggtaagagacaaatggttgcacctttttgtttctgattagcctttccaaaggaggcaatcagatatgcatttatctcagtgagcaaagagatgactttgaatagaatggggggctcccaggtcacaggtaagggacaaatggttgcatctttttgtttctgattagcctttccaaaggaggcaatcagatacgtatttatctcagtgagcaaagagatgactttgaatagaatgggaggcagttttgccctaagcagttcccagcttgaattttcccttttgttgagtgattttgggggcccaagatattttcctttcacacctttgatgcgaacaagctgtttgtttgctatagtcctacttgtctattcttgcttttgttgcctgtgcttttggtgtcagattgatgatatcattgccaaaaccaatgtcaaaaggttttcctctatgttttctttgaagggctttacattttcagtacttacatttaggcttttaatccatttgaaatttatttttgcatatggtgtaagataagcaatttctttgcaatatggatgttcatttttcccgtcactgtttgttgaagaaactgtcatttccccttaaatagtcctgccacccaaagaccgtttaaccatatttgcaaagtttattcccaagttctccaatctgtttaattggtctatatgttcatctttatgccagtgccatattgtttcaattattgtagctttgtaatatattttgatatcaggaagtttgaggcctctggccttctgtttcttgctcaagatttgtttggctattcagggctttttgtggttccatgtatattttagtatcattgttttcctaattctaaaatgccattgaggtcttgataggtattgcactaaatctgcagatcacattgtgaaatacaaatattttaactatatgaagtcttttaataaatgaatataggaggatttttgcatgttgattttgtaccctgcaactttacttggttttaggaggcttttttgtggattctttagagcatgccataggcaaacagggaccattgtacttcttcttttacaatctgtatgttgttaatttcttttccttgcctaagagctttaagtaggacaagggttaaatagaaatggcaagtgcaaacatccttgccatgtttctgatgtcagaggaaaagttcagctttttccatagcatgatattagctatgcactttacatatagggccttcaaaatgttgaaatatttttctcaaattctaggttggcaggagttatcatcataaaatgggtattaaattttgtgaaaactttttttctgaatctattgagatgcacaggtgacatttatccttcattctattaatgtggtatattacattaattgattttgtatgttaggctatccttgcaccccagggataaatgccacttgcttatggcatatactccttttagtgtactgttgaattaattttgctactactttgttgaggatttttgcatctacgtttactagacatattggcttatagttttcttgtggtatctttgacaagctttggtgtaatggtaatgctggccacataaaattagtttgaaagtatttattctttttaaatttttatataatagcttgggaaagatggccattaatttctccttaaatatttggtggcttcaccagaagagccatcttgtcctgggaatttttttgttgtaagtttcttgattactgattcaatcttcattctagttatagatacgctcatattttctatttcttcataattcagtcttggtaggtccttgtctttgtgaattttttcatttcttctaggttatccaatttgttggcctataattgttcttagttgtctcttaccatcttttatatttctgtggcatcagttgcaatgtcttatttctgatttcatttatttaaggcctctcttctttttcttagtctagctaaaggtttgtcaagttatttatattttccaaaaactaactcttagttttgtttactttttatatatcctttccattcactattttatttctgaactaatctttattattttctttattcttctaaatttgaactttgtttgttcttttctacatttctagttgcttgggatatgtattagtccattttcacactgttgataaagacttaactgagagactgggtaatttgtaaagaaaaagaggtttaatggactcacagttccacgtggctggggaggcctcactatcatggcagaaggtaaaacacatgtctcacatggcggcagacaagagagaatgaaagccaagccaaagggggtttccccttataaaaccatctgatttcataagactgattcactaccatgagaacagtatgggggaaaccacccccatgattcaattatctcccactgggtccctccaccaacatgggggaattatgggagctacaattcaagatgagatttgggtggggacacagccaaaccatatcaaggtataaagtgcattgtttgagacctttcttttttcttaatgcagatattcatcactataaacttttcttttagccctacttttactacatcccataagttttgttagactttatttttgttttcatttattctaatgtgtttttaaatttcccttttgatttattctttgcagattggttgttcaaaaatgtattgttaaattatcacatatttattagttttccttttgcaactgatttctagtttcattcccttgatgctgtaaaagatacttgatatgacttcaattttcttaattttcttaagacttcttttatgacctaacatatgatctatcctgcagaatgatccatgtgcacttgagaagaatgtatactctgctgctgttggatggaatgttctgcacatgtctgtaggtgacttgacttgcagtgttgatcaggtcatctgggtctttgttgcctttatgtttggttgttctatccattattaaaagtgagcactg

SEQ ID NO: 146570 - DNA, 446 bp, Homo sapiens
  Payload ID: 8993
  Gene Symbol: KLRD1
  Gene Name: killer cell lectin-like receptor subfamily D, member 1
  ENST ID: ENST00000539792
  CDS Start-End: 1-156
tctgcactctcccagtatctatttccatcatttgaaacttttaatacaaagaactgcatagcgtataatccaaatggaaatgctttagatgaatcctgtgaagataaaaatcgttatatctacaaggtcttgctatgttgcccaggctggtcttgaactcctggcctcaagggattctcccaccttggattcccaaagtgctgggattataggtgtgaaccaccatccctggccctcttcacattcttgtatgaagattgatttgggaaaaatgcatttcaggtaactgacaaaagatataggatgaaaaataatatctttcaaatgtttaatttgaactaagagagcttatgcattgcactttctggagatttgtaatgttttggttttgttgtccatgtgactacaaaataatatattttttaattaaaaaatttaaaataata

SEQ ID NO: 146571 - DNA, 597 bp, Homo sapiens
  Payload ID: 8993
  Gene Symbol: KLRD1
  Gene Name: killer cell lectin-like receptor subfamily D, member 1
  ENST ID: ENST00000539374
  CDS Start-End: 29-349
ctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggcatgattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtgg

SEQ ID NO: 146572 - DNA, 749 bp, Homo sapiens
  Payload ID: 8993
  Gene Symbol: KLRD1
  Gene Name: killer cell lectin-like receptor subfamily D, member 1
  ENST ID: ENST00000544747
  CDS Start-End: 277-694
gccagcccagaaaggggctcccacagtgcagtgggggggctgaagggctcctcaaatgccaccaaagtgggagcccaggcaggggaggtgccgagagcaagcgagggctctgaggactgccagcatgctgtcacttctcagcaggctggattggatttggcacttctttactgaagattctttaatctccagctcagcttcaacaattcaacgctgttctttctgaaaaagtacacatcgtgccttctctacttcgctcttggaacataatttctcatggcagcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtgga

SEQ ID NO: 146573 - DNA, 802 bp, Homo sapiens
  Payload ID: 8993
  Gene Symbol: KLRD1
  Gene Name: killer cell lectin-like receptor subfamily D, member 1
  ENST ID: ENST00000543420
  CDS Start-End: 129-449
gctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggcatgagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacct

SEQ ID NO: 146574 - DNA, 789 bp, Homo sapiens
  Payload ID: 8993
  Gene Symbol: KLRD1
  Gene Name: killer cell lectin-like receptor subfamily D, member 1
  ENST ID: ENST00000543777
  CDS Start-End: 129-605
gctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatgtctacgttgggaattttgttgaaaaattactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaatgatacagttgcatgttatattattactaattgtctacttctggagtctataaaatgtttttaaacagtgtcatatacaattgtcatgtatgtgaaacaatgtgttttaaaattgatgaaattcgttcacct

SEQ ID NO: 146575 - DNA, 1091 bp, Homo sapiens
  Payload ID: 8994
  Gene Symbol: KLRF1
  Gene Name: killer cell lectin-like receptor subfamily F, member 1
  ENST ID: ENST00000279545
  CDS Start-End: 65-610
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 146576 - DNA, 838 bp, Homo sapiens
  Payload ID: 8994
  Gene Symbol: KLRF1
  Gene Name: killer cell lectin-like receptor subfamily F, member 1
  Uniprot ID: Q9NZS2
  ENST ID: ENST00000354855
  CDS Start-End: 65-259
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 146577 - DNA, 598 bp, Homo sapiens
  Payload ID: 8994
  Gene Symbol: KLRF1
  Gene Name: killer cell lectin-like receptor subfamily F, member 1
  ENST ID: ENST00000537723
  CDS Start-End: 25-369
cacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctcca

SEQ ID NO: 146578 - DNA, 730 bp, Homo sapiens
  Payload ID: 8994
  Gene Symbol: KLRF1
  Gene Name: killer cell lectin-like receptor subfamily F, member 1
  ENST ID: ENST00000545196
  CDS Start-End: 25-399
cacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtccctcgtccacattttaggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctcca

SEQ ID NO: 146579 - DNA, 1241 bp, Homo sapiens
  Payload ID: 8994
  Gene Symbol: KLRF1
  Gene Name: killer cell lectin-like receptor subfamily F, member 1
  ENST ID: ENST00000617889
  CDS Start-End: 65-760
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 146580 - DNA, 951 bp, Homo sapiens
  Payload ID: 8994
  Gene Symbol: KLRF1
  Gene Name: killer cell lectin-like receptor subfamily F, member 1
  Uniprot ID: Q9NZS2
  ENST ID: ENST00000612321
  CDS Start-End: 65-301
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttgggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaata

SEQ ID NO: 146581 - DNA, 1096 bp, Homo sapiens
  Payload ID: 8994
  Gene Symbol: KLRF1
  Gene Name: killer cell lectin-like receptor subfamily F, member 1
  ENST ID: ENST00000617793
  CDS Start-End: 65-451
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacaggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttctt

SEQ ID NO: 146582 - DNA, 731 bp, Homo sapiens
  Payload ID: 8995
  Gene Symbol: KLRF2
  Gene Name: killer cell lectin-like receptor subfamily F, member 2
  Uniprot ID: D3W0D1
  ENST ID: ENST00000535540
  CDS Start-End: 108-731
agttttcttttagtaccttgtgccaaagagacatatccaaggttgagattagtttccattttctttgtactattttctggataataagacattagacatttgaagagatggagaatgaagatgggtatatgacgctgagtttcaagaatcgttgtaaatcgaagcagaaatctaaagatttctccctatatccacaatattattgtcttctgctcatatttggatgcattgtgatccttatattcattatgacagggattgacctgaagttctggcataaaaaaatggatttctcccagaatgtaaacgtcagcagtctatcaggacacaattacttgtgcccaaatgactggctgttgaacgaagggaaatgttactggttttcaacttcttttaaaacgtggaaagagagtcaacgtgattgtacacagctacaggcacatttactggtgattcaaaatttggatgagctggagttcatacagaacagtttaaaacctggacattttggttggattggactatatgttacattccaagggaacctatggatgtggatagatgaacactttttagttccagaattgttttcagtgattggaccaactgatgacaggagctgtgccgttatcacaggaaactgggtgtattctgaagactgtagctccacatttaagggcatttgccagagagatgcgatcttgacgcacaatggaaccagtggtgtgtaa

SEQ ID NO: 146583 - DNA, 1335 bp, Homo sapiens
  Payload ID: 8996
  Gene Symbol: KLRG1
  Gene Name: killer cell lectin-like receptor subfamily G, member 1
  Uniprot ID: Q96E93
  ENST ID: ENST00000266551
  CDS Start-End: 16-603
agatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaagaatgaaaa

SEQ ID NO: 146584 - DNA, 1206 bp, Homo sapiens
  Payload ID: 8996
  Gene Symbol: KLRG1
  Gene Name: killer cell lectin-like receptor subfamily G, member 1
  Uniprot ID: Q96E93
  ENST ID: ENST00000356986
  CDS Start-End: 96-665
agtttagagattgggctgtttcctcactgatacatatcccttcacacttctataatttaactctctcaactgcatgtgaaagatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctattt

SEQ ID NO: 146585 - DNA, 532 bp, Homo sapiens
  Payload ID: 8996
  Gene Symbol: KLRG1
  Gene Name: killer cell lectin-like receptor subfamily G, member 1
  ENST ID: ENST00000543895
  CDS Start-End: 292-532
aaaaggaatctttatggcctggatctcagttcccactaggccaaattgctttaagatgcgatatccttccctgactttctcttttctttcaacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttg

SEQ ID NO: 146586 - DNA, 592 bp, Homo sapiens
  Payload ID: 8996
  Gene Symbol: KLRG1
  Gene Name: killer cell lectin-like receptor subfamily G, member 1
  ENST ID: ENST00000539240
  CDS Start-End: 349-592
agttctcacgctaggtctcctccgggcgcttccctagcccgttcgccgcctgagagggacgctgttccgccgcgtggaagcttcgagtctcgactccactgttgacccctagacgagagtagtgcagcgacggggccgtgatgtgcgtcctggctttcttaacgacacctctcctctgtatttcctttttccacttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgc

SEQ ID NO: 146587 - DNA, 2197 bp, Homo sapiens
  Payload ID: 8997
  Gene Symbol: KLRG2
  Gene Name: killer cell lectin-like receptor subfamily G, member 2
  Uniprot ID: A4D1S0
  ENST ID: ENST00000340940
  CDS Start-End: 71-1300
ggagagcgaagctcctctgcactgggcccaggtgcgctcctcagcgtctccgggtggcggggcgcgcgggatggaggagtcttgggaggctgcgcccggaggccaagccggggcagagctcccaatggagcccgtgggaagcctggtccccacgctggagcagccgcaggtgcccgcgaaggtgcgacaacctgaaggtcccgaaagcagcccaagtccggccggggccgtggagaaggcggcgggcgcaggcctggagccctcgagcaagaaaaagccgccttcgcctcgccccgggtccccgcgcgtgccgccgctcagcctgggctacggggtctgccccgagccgccgtcaccgggccctgccttggtcaagctgccccggaatggcgaggcgcccggggctgagcctgcgcccagcgcctgggcgcccatggagctgcaggtagatgtgcgcgtgaagcccgtgggcgcggccggtggcagcagcacgccatcgcccaggccctccacgcgcttcctcaaggtgccggtgcccgagtcccctgccttctcccgccacgcggacccggcgcaccagctcctgctgcgcgcaccatcccagggcggcacgtggggccgccgctcgccgctggctgcagcccggacggagagcggctgcgacgcagagggccgggccagccccgcggaaggaagcgccggctccccgggctcccccacgtgctgccgctgcaaggagctggggctggagaaggaggatgcggcgctgttgccccgcgcggggttggacggcgacgagaagctgccccgggccgtaacgcttacggggctacccatgtacgtgaagtccctgtactgggccctggcgttcatggctgtgctcctggcagtctctggggttgtcattgtggtcctggcctcaagagcaggagccagatgccagcagtgccccccaggctgggtgttgtccgaggagcactgttactacttctctgcagaagcgcaggcctgggaagccagccaggctttctgctcagcctaccacgctaccctccccctgctaagccacacccaggacttcctgggcagatacccagtctccaggcactcctgggtgggggcctggcgaggcccccagggctggcactggatcgacgaggccccactcccgccccagctactccctgaggacggcgaggacaatctggatatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcggtttgatgacattgggatggttgtttagcatttctgtgccttggtttcattaaaatgacaatttccccctagaggaaaaagacagggttaacaaccacagcggattccaatctgggttctcattccggctcatggaaatgagtctgccgttgttcagtggcagtgggacttggcagggataacgtcattgctgtgaattctacttcaggcagctgggtgtacatcggacacagcctaccggcagcctctggaaaattaaccaaggaaaaggagcggtcagccctggaaagaggggagagcaaggttttccttccccaccctgagagttggcaaagggttggcagacaggaaggttctgggtggagatcccgcatgtgggctggccagcccctggcacgctgatgcccaagggtgagacaaggcagagaggacagggccacctggcaggagaagccaggagagcaccccagcttggtaggtggaagctgaggagtctgagtgaaaaaggaaatcagagaaatgcaggcacgttccaggcagctcttctacccacagctgcagagacgaccaacctgaagatgtctccatgctggggtgcagtgaagaccttcaggctggaggatgtggctgacagagttgtgtagttcct

SEQ ID NO: 146588 - DNA, 1148 bp, Homo sapiens
  Payload ID: 8997
  Gene Symbol: KLRG2
  Gene Name: killer cell lectin-like receptor subfamily G, member 2
  Uniprot ID: A4D1S0
  ENST ID: ENST00000393039
  CDS Start-End: 22-966
ccgggtggcggggcgcgcgggatggaggagtcttgggaggctgcgcccggaggccaagccggggcagagctcccaatggagcccgtgggaagcctggtccccacgctggagcagccgcaggtgcccgcgaaggtgcgacaacctgaaggtcccgaaagcagcccaagtccggccggggccgtggagaaggcggcgggcgcaggcctggagccctcgagcaagaaaaagccgccttcgcctcgccccgggtccccgcgcgtgccgccgctcagcctgggctacggggtctgccccgagccgccgtcaccgggccctgccttggtcaagctgccccggaatggcgaggcgcccggggctgagcctgcgcccagcgcctgggcgcccatggagctgcaggtagatgtgcgcgtgaagcccgtgggcgcggccggtggcagcagcacgccatcgcccaggccctccacgcgcttcctcaaggtgccggtgcccgagtcccctgccttctcccgccacgcggacccggcgcaccagctcctgctgcgcgcaccatcccagggcggcacgtggggccgccgctcgccgctggctgcagcccggacggagagcggctgcgacgcagagggccgggccagccccgcggaaggaagcgccggctccccgggctcccccacgtgctgccgctgcaaggagctggggctggagaaggaggatgcggcgctgttgccccgcgcggggttggacggcgacgagaagctgccccgggccgtaacgcttacggactccctgaggacggcgaggacaatctggatatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcgg

SEQ ID NO: 146589 - DNA, 1553 bp, Homo sapiens
  Payload ID: 8998
  Gene Symbol: KLRK1
  Gene Name: killer cell lectin-like receptor subfamily K, member 1
  Uniprot ID: P26718
  ENST ID: ENST00000240618
  CDS Start-End: 142-792
tgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 146590 - DNA, 734 bp, Homo sapiens
  Payload ID: 8998
  Gene Symbol: KLRK1
  Gene Name: killer cell lectin-like receptor subfamily K, member 1
  ENST ID: ENST00000396451
  CDS Start-End: 191-433
ccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcct

SEQ ID NO: 146591 - DNA, 951 bp, Homo sapiens
  Payload ID: 8998
  Gene Symbol: KLRK1
  Gene Name: killer cell lectin-like receptor subfamily K, member 1
  Uniprot ID: P26718
  ENST ID: ENST00000540818
  CDS Start-End: 167-817
cacaggggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactcc

SEQ ID NO: 146592 - DNA, 4277 bp, Homo sapiens
  Payload ID: 8999
  Gene Symbol: KLLN
  Gene Name: killin, p53-regulated DNA replication inhibitor
  Uniprot ID: B2CW77
  ENST ID: ENST00000445946
  CDS Start-End: 951-1487
gcagggcagggcagggggcggtaggagggggcagagcggtagctctgggtgcgagcgcagagtccccaagccgcaggctctactgagcatgcccagtgtagctgcctggggcttgctcgggccggttcccagccgccagcctgcagctgcacttgctgcggcttttgcagcaacgcgaggcgaggataacgagctaagcctcggcctctgcccagaaacccagccggaggcagggtaggctgttgtggggcgggggtggaggactgatgatgaaagctgagatgggtgcgttgagcagtgtcactgactcgagtctgaggttacctgtgcacaggtgaaaaggaccaggtgaccacgctgctcagtgtagagggaaatgcagggacggtccctgcaaggggaataccctccccccttgcctctacccctagatttccgcggcgtggactgcattcgctctttccttttgcaccgctgtcggatcacaatcgttcgcagagatttgactgtaacagcctttgcctagagattcccccttcccccaaatctgtgtcctcatggtgtcagtcttagcacaaagagcaacctgctattgtgtcgccagcgtgtatcacctcatccggctcccttgcagcgccccacctctcgcttccccggtaactcggctcgtttgccctaaaaatgaaagctctcagccgagcgtgctgaacgtgaacacatagccgttgaatttcaagggcccaaagggcacctatctaaatgaactgaaagaggatccctgtgagtgggacgcaccccgcaggcctctcctgcgcccgctccggtgcccccaagagagtcgagcatctttcccctcgggctccaggtcggttcgcggcgtcggagtcaagctcggttctcagagaccacctagccccgcccccccttggccgccgtgaaaacccggcaggatggatcgcccggggccaggctccgcgcgccccggccggaccgtgcacgtttggggttaccgggttgagtggaaagtacggaacggtaggaagctgcagcccagcgagtgggcggggcgaggagacctaggagggttcaaaaggaggtggaaggatacacgggccacagtcggaactactttccgaaggaggtcacgtgtgtccctagttggggaactttccaaattcccactccccagtgatagctccggaggcaagtcgtcttcttcctttgctcggggtgctcttgcctggtgcaggcagcggaaccccaacccttcctgcgccgcggcggaaacaggggctcggaccagcctcccgaaggagcgctgtcggggctggcgcttggggaactggttacacaagcacccacatccaaacacgtgcccccgcctccccgcctgctggctgccgccgattcttacagaacgcggggagagagtccccaaactggtgccactcctcgcctgctaccctaagagcaagccaaaggactgagacctgagactcactccttgctctacatcgacctattctgcgccttcccaaacgtgggaaaaggagctgggcgctagggctctcgggcctctccatcgctgatgccctgccgcttagggtgaacccttttggttctgtgcttgagggtatctcctgctgcagcccagagcgtgcattctccgatgttgcaacaaacgtccagtcactacccctgagctggtgagcgcgccccacctactgtggactcagccaagtgacttatctggtctgagaacctagtcaatggccgtcagcccagaacaaacctgtcaagtctgtttacagccccgattgggctgacctgtcaccgtgagagagctgattcggaaatgctgagagttggatcgcactcctaccccgcaccccacccgtcaaggatctacaaagcaagtagtcgacccgcttaaagagaatgagcatcaacaccagtctgggaatttattgttttttcatttcccttaggaagtagaactacagacgacaatttgagtcaaaaaatatctaacgagacctaggttgaagcactgagttgtttttcaaactttgagagaatgagaatcaatctgcatgtgtgttcaataattgtaagtgcctagcaaagtctaaagagggtttatgctgtatttgagaaagagtactgtatatgtgcacatcatagttgcaggcaacctctgaagactagaaacctcaagagacctagcgcagaaagccacaggccattacctaactccgggactactaattaaacctgggatatttacagtgttcttagagacctctgaggctccataaaactttgcacttatatacagcatttaagatagctgtgcaggagttaacaacctgctgaagcttcagtgttgatatttattgaagactggttttgtgcatagttctggtcagcttgggaaaggcaaggaccacagtggaaaaggaaatggaaagcaaccggaaaagagtaagagaaaggcctccagttgatttccagagatgcagatactgtccacacagcctagcgtgaactacagatttcattattgtataaataaccaaagataaggagttcctgatgtctaggtgttctactagattgcatggtaaaaaccagagctgtgtttaattatcaattactgcgtggtagaaaaagggaaaatgaagatgaacttttaaaaggggagtagattagggaggggtaaaatgtctcacatttgtttcttagattgctgatcttgtctccagagtccctgttattagcactgcccttctctgtccctcccctggagcctaccctaagtgacaattagtctcatagcatctgagaatctctgaaatctgctttcatggaagcaaatgaaacaagggtgcattcctgtcctggtgcgacagaatcctcttggattccatggcacagagttactctggagcagagataatctgcatcaccagcactaaagtgctagaatatgagaccagcctccaagtacttccatccggctgaagaaagaaaatgggaaatgggttttactgcttctctaaacatcaggtccctctacttctctctagtggtgaatgaaaggatcatcaatgttggcagatatttggccagcccaacagcaacatcaggtggttattaggagttggtgaataaaatcctccttctgttcctagtgttaagttgtttctgaaagaaatactgatgcatccttttccaattttttgtttttcttttcctttctacccaaatggctggccctatctaaactaaagaaagtttcaaaaatagtacttttttaaagttcagttgaaaatacctgcttggctgtatagatattacaatacactggtctccaagcacttcagttctttttttttttttctttttttttttttttttttgagacggagtctcacaggctggagtgcagtggcatgatctcggttcactgcaacctctgcctcccaggttcaagcaattcccctgcctcagcctcccgagtagctgggactacaggcgcacaccatcatgccgggctaattttttgtagtttagtaaagacagggtttcaccatgttggtcaggatggtctcgatctcctgacctcgtgatctgcccgccacggcctcccaaagtgctgggattacaggcgtgagccaccgcgcccggccatacttagttctttacctgtctggattcagaaccagaataccatagggagaagtagaagcttgtaacaaagggacaattatataaagcttcagggtgactatgtagattgattagtaagcatggtaaactagctttaattatcgcttctaacagctgattccaaaactctattgttactacaccaaaataatgtcgaaagaaaatttctttcttattttctttgataagcgaaatgaccagcaacttgatgtggatgatataaatacttgatgtgctctttgtaggtcatctgctaagatgtcttttgtgtaaacactctgatctctatagtgcctttctcatctcccatacgctgacctttcaaaaagggatctaactcaatagctttaatttttaaacaatcttctgtatttctgtctgtttaactactgttttctaaataatacagaatataaaaacataataatcattggattgaatgtaaacccattgttccaagggtctgaggttttccccttatttcatttatcctaataacaaacattattgttctttcaataaagataattttaagacattctcca

SEQ ID NO: 146593 - DNA, 4278 bp, Homo sapiens
  Payload ID: 8999
  Gene Symbol: KLLN
  Gene Name: Killin, p53-regulated DNA replication inhibitor
  ENST ID: ENST00000635224
  CDS Start-End: 951-1487
gcagggcagggcagggggcggtaggagggggcagagcggtagctctgggtgcgagcgcagagtccccaagccgcaggctctactgagcatgcccagtgtagctgcctggggcttgctcgggccggttcccagccgccagcctgcagctgcacttgctgcggcttttgcagcaacgcgaggcgaggataacgagctaagcctcggcctctgcccagaaacccagccggaggcagggtaggctgttgtggggcgggggtggaggactgatgatgaaagctgagatgggtgcgttgagcagtgtcactgactcgagtctgaggttacctgtgcacaggtgaaaaggaccaggtgaccacgctgctcagtgtagagggaaatgcagggacggtccctgcaaggggaataccctccccccttgcctctacccctagatttccgcggcgtggactgcattcgctctttccttttgcaccgctgtcggatcacaatcgttcgcagagatttgactgtaacagcctttgcctagagattcccccttcccccaaatctgtgtcctcatggtgtcagtcttagcacaaagagcaacctgctattgtgtcgccagcgtgtatcacctcatccggctcccttgcagcgccccacctctcgcttccccggtaactcggctcgtttgccctaaaaatgaaagctctcagccgagcgtgctgaacgtgaacacatagccgttgaatttcaagggcccaaagggcacctatctaaatgaactgaaagaggatccctgtgagtgggacgcaccccgcaggcctctcctgcgcccgctccggtgcccccaagagagtcgagcatctttcccctcgggctccaggtcggttcgcggcgtcggagtcaagctcggttctcagagaccacctagccccgcccccccttggccgccgtgaaaacccggcaggatggatcgcccggggccaggctccgcgcgccccggccggaccgtgcacgtttggggttaccgggttgagtggaaagtacggaacggtaggaagctgcagcccagcgagtgggcggggcgaggagacctaggagggttcaaaaggaggtggaaggatacacgggccacagtcggaactactttccgaaggaggtcacgtgtgtccctagttggggaactttccaaattcccactccccagtgatagctccggaggcaagtcgtcttcttcctttgctcggggtgctcttgcctggtgcaggcagcggaaccccaacccttcctgcgccgcggcggaaacaggggctcggaccagcctcccgaaggagcgctgtcggggctggcgcttggggaactggttacacaagcacccacatccaaacacgtgcccccgcctccccgcctgctggctgccgccgattcttacagaacgcggggagagagtccccaaactggtgccactcctcgcctgctaccctaagagcaagccaaaggactgagacctgagactcactccttgctctacatcgacctattctgcgccttcccaaacgtgggaaaaggagctgggcgctagggctctcgggcctctccatcgctgatgccctgccgcttagggtgaacccttttggttctgtgcttgagggtatctcctgctgcagcccagagcgtgcattctccgatgttgcaacaaacgtccagtcactacccctgagctggtgagcgcgccccacctactgtggactcagccaagtgacttatctggtctgagaacctagtcaatggccgtcagcccagaacaaacctgtcaagtctgtttacagccccgattgggctgacctgtcaccgtgagagagctgattcggaaatgctgagagttggatcgcactcctaccccgcaccccacccgtcaaggatctacaaagcaagtagtcgacccgcttaaagagaatgagcatcaacaccagtctgggaatttattgttttttcatttcccttaggaagtagaactacagacgacaatttgagtcaaaaaatatctaacgagacctaggttgaagcactgagttgtttttcaaactttgagagaatgagaatcaatctgcatgtgtgttcaataattgtaagtgcctagcaaagtctaaagagggtttatgctgtatttgagaaagagtactgtatatgtgcacatcatagttgcaggcaacctctgaagactagaaacctcaagagacctagcgcagaaagccacaggccattacctaactccgggactactaattaaacctgggatatttacagtgttcttagagacctctgaggctccataaaactttgcacttatatacagcatttaagatagctgtgcaggagttaacaacctgctgaagcttcagtgttgatatttattgaagactggttttgtgcatagttctggtcagcttgggaaaggcaaggaccacagtggaaaaggaaatggaaagcaaccggaaaagagtaagagaaaggcctccagttgatttccagagatgcagatactgtccacacagcctagcgtgaactacagatttcattattgtataaataaccaaagataaggagttcctgatgtctaggtgttctactagattgcatggtaaaaaccagagctgtgtttaattatcaattactgcgtggtagaaaaagggaaaatgaagatgaacttttaaaaggggagtagattagggaggggtaaaatgtctcacatttgtttcttagattgctgatcttgtctccagagtccctgttattagcactgcccttctctgtccctcccctggagcctaccctaagtgacaattagtctcatagcatctgagaatctctgaaatctgctttcatggaagcaaatgaaacaagggtgcattcctgtcctggtgcgacagaatcctcttggattccatggcacagagttactctggagcagagataatctgcatcaccagcactaaagtgctagaatatgagaccagcctccaagtacttccatccggctgaagaaagaaaatgggaaatgggttttactgcttctctaaacatcaggtccctctacttctctctagtggtgaatgaaaggatcatcaatgttggcagatatttggccagcccaacagcaacatcaggtggttattaggagttggtgaataaaatcctccttctgttcctagtgttaagttgtttctgaaagaaatactgatgcatccttttccaattttttgtttttcttttcctttctacccaaatggctggccctatctaaactaaagaaagtttcaaaaatagtacttttttaaagttcagttgaaaatacctgcttggctgtatagatattacaatacactggtctccaagcacttcagttctttttttttttttcttttttttttttttttttttgagacggagtctcacaggctggagtgcagtggcatgatctcggttcactgcaacctctgcctcccaggttcaagcaattcccctgcctcagcctcccgagtagctgggactacaggcgcacaccatcatgccgggctaattttttgtagtttagtaaagacagggtttcaccatgttggtcaggatggtctcgatctcctgacctcgtgatctgcccgccacggcctcccaaagtgctgggattacaggcgtgagccaccgcgcccggccatacttagttctttacctgtctggattcagaaccagaataccatagggagaagtagaagcttgtaacaaagggacaattatataaagcttcagggtgactatgtagattgattagtaagcatggtaaactagctttaattatcgcttctaacagctgattccaaaactctattgttactacaccaaaataatgtcgaaagaaaatttctttcttattttctttgataagcgaaatgaccagcaacttgatgtggatgatataaatacttgatgtgctctttgtaggtcatctgctaagatgtcttttgtgtaaacactctgatctctatagtgcctttctcatctcccatacgctgacctttcaaaaagggatctaactcaatagctttaatttttaaacaatcttctgtatttctgtctgtttaactactgttttctaaataatacagaatataaaaacataataatcattggattgaatgtaaacccattgttccaagggtctgaggttttccccttatttcatttatcctaataacaaacattattgttctttcaataaagataattttaagacattctcca

SEQ ID NO: 146594 - DNA, 2874 bp, Homo sapiens
  Payload ID: 9000
  Gene Symbol: KIRREL
  Gene Name: kin of IRRE like (Drosophila)
  Uniprot ID: Q96J84
  ENST ID: ENST00000359209
  CDS Start-End: 68-2341
ccgctcctctggctcgctcgccaactccgggccccagccgcgggcgggcgcacggcgggcggacagcatgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacaggg

SEQ ID NO: 146595 - DNA, 3304 bp, Homo sapiens
  Payload ID: 9000
  Gene Symbol: KIRREL
  Gene Name: kin of IRRE like (Drosophila)
  ENST ID: ENST00000360089
  CDS Start-End: 592-2373
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaaggtaaggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcaaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaa

SEQ ID NO: 146596 - DNA, 6870 bp, Homo sapiens
  Payload ID: 9000
  Gene Symbol: KIRREL
  Gene Name: kin of IRRE like (Drosophila)
  ENST ID: ENST00000368172
  CDS Start-End: 13-1728
acttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctccacccagaccccaaaaataaatggatccatgatgataattaagagaagagaaaaaaagatattatttttgttaggacaaaccattgtaggtttttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagta

SEQ ID NO: 146597 - DNA, 7519 bp, Homo sapiens
  Payload ID: 9000
  Gene Symbol: KIRREL
  Gene Name: kin of IRRE like (Drosophila)
  ENST ID: ENST00000368173
  CDS Start-End: 405-2378
ggcgccgtcggagggagagtagacgtcaggcggagggagggaggcaggcaggcagggaggcagggagggagagagggaaggaagagaaggggagagaaagggggagcaaagaccgaaagagacccagagagatacagcttgagaggagaaataattaaagggggagggcgaccaggaggagaaaaaggtctgggaggaaagagagataaagagaatcggagggcagggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctcccaagtccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgcaacatggtgatgcctcagtagttggtgatcctgatcacctttggtggcttgttttagtggaaagagcaagggactaaaggtcaggagacccaggacccagtcctgaagctgcaaaggttagatctcggcctaactttctgttcattgcccccaatttgtctggcctgtaaaatgaagggggagggttgcataaacctaaaactattctggttttgttatacccatagggttgggggtagggatgggactgcccattgctggcaaggaactgggaacagtagcaagcatggtgagggctggagagctggctgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctccacccagaccccaaaaataaatggatccatgatgataattaagagaagagaaaaaaagatattatttttgttaggacaaaccattgtaggtttttagcaatgtgtatctgtgtgtccctcacaccttttcctattctacttttttttcctttttttaaaaatattatgtactatatttttagtctcaaacacactatatattatatatatttaatttttttatatatataaatataaatgttttaaaaagt

SEQ ID NO: 146598 - DNA, 1969 bp, Homo sapiens
  Payload ID: 9001
  Gene Symbol: KIRREL2
  Gene Name: kin of IRRE like 2 (Drosophila)
  ENST ID: ENST00000262625
  CDS Start-End: 15-1916
accttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtccacccgcgtctccagactcacgtgtgacatctttccaatggaagagtcctgggatctccaacttgccataatggattgttctgatttctgaggagccaggacaagttggcgaccttactcctcc

SEQ ID NO: 146599 - DNA, 2015 bp, Homo sapiens
  Payload ID: 9001
  Gene Symbol: KIRREL2
  Gene Name: kin of IRRE like 2 (Drosophila)
  ENST ID: ENST00000347900
  CDS Start-End: 211-1962
cagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtccacccgcgtctccagactcacgtgtgacatctttccaatggaagagtcctgggatctccaacttgccataatggattgttctgatttctgaggagccaggacaagttggcgaccttactcctcc

SEQ ID NO: 146600 - DNA, 2942 bp, Homo sapiens
  Payload ID: 9001
  Gene Symbol: KIRREL2
  Gene Name: kin of IRRE like 2 (Drosophila)
  Uniprot ID: Q6UWL6
  ENST ID: ENST00000360202
  CDS Start-End: 199-2325
ccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagacttgctgcccactgtgcggatagtggccggagtggccgctgccaccacaactctccttatggtcatcactggggtggccctctgctgctggcgccacagcaaggcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttccaatggaagagtcctgggatctccaacttgccataatggattgttctgatttctgaggagccaggacaagttggcgaccttactcctccaaaactgaacacaaggggagggaaagatcattacatttgtcaggagcatttgtatacagtcagctcagccaaaggagatgccccaagtgggagcaacatggccacccaatatgcccacctattccccggtgtaaaagagattcaagatggcaggtaggccctttgaggagagatggggacagggcagtgggtgttgggagtttggggccgggatggaagttgtttctagccactgaaagaagatatttcaagatgaccatctgcattgagaggaaaggtagcataggatagatgaagatgaagagcataccaggccccaccctggctctccctgaggggaactttgctcggccaatggaaatgcagccaagatggccatatactccctaggaacccaagatggccaccatcttgattttactttccttaaagactcagaaagacttggacccaaggagtggggatacagtgagaattaccactgttggggcaaaatattgggataaaaatatttatgttt

SEQ ID NO: 146601 - DNA, 2563 bp, Homo sapiens
  Payload ID: 9001
  Gene Symbol: KIRREL2
  Gene Name: kin of IRRE like 2 (Drosophila)
  ENST ID: ENST00000592409
  CDS Start-End: 534-2555
cactgagcgcagtccctctaggacctgggctgagcaagtttcttccactctctcccttccctcctcctcaccccttgcctgcccctcaaccccggcagggcgcaggtgtccaacccagccgggaccccctccctcctcgaacccaggtgttccggctcccagaccccaattgagctgggggcgcccacccgccgggggatcccgccctgcgtcccccattcatccgcgtctcagccgcgggagtttctcaacgggaagagggcggagctcccggggggcggacccgggcggggcgagcgggatcgggccctcttggggtctcccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtaccccccagaggtgactctgtctgcttcgccacacactgtgcaggagggagagaaggtcattttcctgtgccaggccacagcccagcctcctgtcacaggctacaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtttgggccgattctgcaggcaaagccggagcccgtgtccgtggacgtgggggaagacgcttccttcagctgcgcctggcgcgggaacccgcttccacgggtaacctggacccgccgcggtggcgcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacgctcccccagtagtgaccgccctgcactctgcgcctgccttcctgaggggccctgctcgcctccagtgtctggttttcgcctctcccgccccagatgccgtggtctggtcttgggatgagggcttcctggaggcggggtcgcagggccggttcctggtggagacattccctgccccagagagccgcgggggactgggtccgggcctgatctctgtgctacacatttcggggacccaggagtctgactttagcaggagctttaactgcagtgcccggaaccggctgggcgagggaggtgcccaggccagcctgggccgtagagcctcagcctctttctccgagcaaaagaacctgatgcgaatccctggcagcagcgacggctccagttcacgaggtcctgaagaagaggagacaggcagccgcgaggaccggggccccattgtgcacactgaccacagtgatctggttctggaggaggaagggactctggagaccaaggacccaaccaacggttactacaaggtccgaggagtcagtgtgagcctgagccttggcgaagcccctggaggaggtctcttcctgccaccaccctccccccttgggcccccagggacccctaccttctatgacttcaacccacacctgggcatggtccccccctgcagactttacagagccagggcaggctatctcaccacaccccaccctcgagctttcaccagctacatcaaacccacatcctttgggcccccagatctggcccccgggactccccccttcccatatgctgccttccccacacctagccacccgcgtctccagactcacgtgtgacatctttc

SEQ ID NO: 146602 - DNA, 767 bp, Homo sapiens
  Payload ID: 9001
  Gene Symbol: KIRREL2
  Gene Name: kin of IRRE like 2 (Drosophila)
  ENST ID: ENST00000586102
  CDS Start-End: 195-767
tgcacttgagtgcaccttgagtctccagcctctcaaggaaccgggagatcaggccatcagcgtctcagccagcaaaggcctgaaccaccagtcccttataaccctgcgtttcagagcgtcagaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctggtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcagaccctgctgaaggaagggacccctgggtcagtggagagcaccttaaccctg

SEQ ID NO: 146603 - DNA, 3508 bp, Homo sapiens
  Payload ID: 9002
  Gene Symbol: KIRREL3
  Gene Name: kin of IRRE like 3 (Drosophila)
  ENST ID: ENST00000416561
  CDS Start-End: 74-2287
tccagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtccggtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcttcctagacaataaaggcagttgatagctctg

SEQ ID NO: 146604 - DNA, 3397 bp, Homo sapiens
  Payload ID: 9002
  Gene Symbol: KIRREL3
  Gene Name: kin of IRRE like 3 (Drosophila)
  ENST ID: ENST00000529097
  CDS Start-End: 12-2312
tgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtccggtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaa

SEQ ID NO: 146605 - DNA, 2474 bp, Homo sapiens
  Payload ID: 9002
  Gene Symbol: KIRREL3
  Gene Name: kin of IRRE like 3 (Drosophila)
  Uniprot ID: Q8IZU9
  ENST ID: ENST00000525704
  CDS Start-End: 302-2104
gcccgcctgaggaagccgtgtgcctgggatgccaagagccagagaatggatcttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaagtacgggagggagatccgggatctcagggagggggacagagaaaaaggccaggcttaggctgccccggagagcaagtaagcaggagtgcaatgaacaggggtcctaacagtgctgtgagctcctggggcagggagtgggtctgatgcatcggtgtatgtgagcctgggcaacatggcgcctggcagagtgggcgctaggctgaggttgacctggactagactgaacttcatctgcagggcagccagcattttggattgaacacatagctctttcagtcaggaactgtacagaaagatagggggaaaagcggtttgtggtttgatccttgctctacaagagctgttagtctagagagaccccatctctacaacaaaataaaaataaagagctgctagtctcaccagaaaagcaggtcactcacacagctgtgggggagtgggtggggaagcaataaaggaattgctttgagaaaactt

SEQ ID NO: 146606 - DNA, 3808 bp, Homo sapiens
  Payload ID: 9002
  Gene Symbol: KIRREL3
  Gene Name: kin of IRRE like 3 (Drosophila)
  Uniprot ID: Q8IZU9
  ENST ID: ENST00000525144
  CDS Start-End: 251-2587
cttctccgagtggggacattgctgacaatcccggcttcccgaggcggctaagaacaggcagtttgtgtcggctggctgcagatacccagaggcacaaagagaccgaagccacccggagggacccacggacggacagatggtaggcgcgaacccgagaggaccggcggaggctgagcaccgagagccgccaaggaagagaaactaaccacagccaagttaccccgccggctttccttcgctgcgctaaggaatgaaacccttccagctcgatctgctcttcgtctgcttcttcctcttcagtcaagagctgggcctccagaagagaggatgctgtctggtgctgggctacatggccaaggacaagtttcggagaatgaatgaaggccaagtctattccttcagccagcagccccaggaccaggtggtggtgtcgggacagccagtgacgctactttgcgccatccccgaatacgatggcttcgttctgtggatcaaggacggcttggctctgggtgtgggcagggacctctcaagttacccacagtacctggtggtagggaaccacctgtcaggggagcaccacctgaagatcctgagggcagagctgcaagacgatgcggtgtacgagtgccaggccatccaggccgccatccgctcccgccccgcacgcctcacagtcctggtgccgcctgatgaccccgtcatcctggggggccctgtgatcagcctgcgtgcgggggaccctctcaacctcacctgccacgcagacaatgccaagcctgcagcctccatcatctggttgcgaaagggagaggtcatcaatggggccacctactccaagaccctgcttcgggacggcaagcgggagagcatcgtcagcaccctcttcatctcccctggtgacgtggagaatggccagagcatcgtgtgtcgtgccaccaacaaagccatccccggaggaaaggagacgtcggtcaccattgacatccagcaccctccactggtcaacctctcggtggagccacagccagtgctggaggacaacgtcgtcactttccactgctctgcaaaggccaacccagctgtcacccagtacaggtgggccaagcggggccagatcatcaaggaggcatctggagaggtgtacaggaccacagtggactacacgtacttctcagagcccgtctcctgtgaggtgaccaacgccctgggcagcaccaacctcagccgcacggttgacgtctactttgggccccggatgaccacagaaccccaatccttgctcgtggatctgggctctgatgccatcttcagctgcgcctggaccggcaacccatccctgaccatcgtctggatgaagcggggctccggagtggtcctgagcaatgagaagaccctgaccctcaaatccgtgcgccaggaggacgcgggcaagtacgtgtgccgggctgtggtgccccgtgtgggagccggggagagagaggtgaccctgaccgtcaatggaccccccatcatctccagcacccagacccagcacgccctccacggcgagaagggccagatcaagtgcttcatccggagcacgccgccgccggaccgcatcgcctggtcctggaaggagaacgttctggagtcgggcacatcggggcgctatacggtggagaccatcagcaccgaggagggcgtcatctccaccctgaccatcagcaacatcgtgcgggccgacttccagaccatctacaactgcacggcctggaacagcttcggctccgacactgagatcatccggctcaaggagcaaggttcggaaatgaagtcgggagccgggctggaagcagagtctgtgccgatggccgtcatcattggggtggccgtaggagctggtgtggccttcctcgtccttatggcaaccatcgtggcgttctgctgtgcccgttcccagagaaatctcaaaggtgttgtgtcagccaaaaatgatatccgagtggaaattgtccacaaggaaccagcctctggtcgggagggtgaggagcactccaccatcaagcagctgatgatggaccggggtgaattccagcaagactcagtcctgaaacagctggaggtcctcaaagaagaggagaaagagtttcagaacctgaaggaccccaccaatggctactacagcgtcaacaccttcaaagagcaccactcaaccccgaccatctccctctccagctgccagcccgacctgcgtcctgcgggcaagcagcgtgtgcccacaggcatgtccttcaccaacatctacagcaccctgagcggccagggccgcctctacgactacgggcagcggtttgtgctgggcatgggcagctcgtccatcgagctttgtgagcgggagttccagagaggctccctcagcgacagcagctccttcctggacacgcagtgtgacagcagcgtcagcagcagcggcaagcaggatggctatgtgcagttcgacaaggccagcaaggcttctgcttcctcctcccaccactcccagtcctcgtcccagaactctgaccccagtcgacccctgcagcggcggatgcagactcacgtctaaggatcacacaccgcgggtggggacgggccagggaagaggtcagggcacgttctggttgtccagggacgaggggtactttgcagaggacaccagaattggccacttccaggacagcctcccagcgcctctgccactgccttccttcgaagctctgatcaagcacaaatctgggtccccaggtgctgtgtgccagaggtgggcgggtggggagacagacagaggctgcggctgagtgcgctgtgcttagtgctggacacccgtgtccccggccctttcctggaggcccctctaccacctgctctgcccacaggcacaagtggcagctataactctgctttcatgaaactgcggtccactctctggtctctctgtgggctctacccctcgctgaccagaagctctacctacccctgtgcctgtgctcccatacagccctggggagaaggggatgacgtcttcccagcactgagctgccccagaaaccccggctccccactgctgctcatagcccataccctggaggctgacaagccagaaatggccttggctaaaggagcctctctctcaccaggctggccgggagcccacccccaatttgtttggtgttttgtgtccatactcttgcagttctgtccttggacttgatgccgctgaactctgcggtgggaccggtccggtcagagcctggtgtactggggggagggagggaggagggagcctgtgctgacggagcacctcgccgggtgtgcccctcctgggctgtgtgaccccagcctccccacccacctcctgctttgtgtactcctcccctccccctcagcacaatcggagttcatataagaagtgcgggagcttctctggtcagggttctctgaacacttatggagagagtgcttcctgggaagtgtggcgtttgaaggggctggagggcaggtctttaagatggcgagactgcccttctcagctgataaacacaagaacggcgatcctgtcttcagtaaggctccacgagaagagaggaagtatatctacacctcaaccctcctagtcaccacctgaaataaatgttagggacactactccaacatgtttgttctgttcttttgttcctacaaagccacaggaagaacccaagagctcatagaatgcgttgggaacccaaggttctctgccctcctttgattcaatcttcctagacaataaaggcagttgatagctctg

SEQ ID NO: 146607 - DNA, 6348 bp, Homo sapiens
  Payload ID: 9003
  Gene Symbol: KIN
  Gene Name: Kin17 DNA and RNA binding protein
  Uniprot ID: O60870
  ENST ID: ENST00000379562
  CDS Start-End: 49-1230
ggctggctgagtactggggtccagaaagtgatcgctgccgtggtcgccatggggaagtcggattttcttactcccaaggctatcgccaacaggatcaagtccaaggggctgcagaagctacgctggtattgccagatgtgccagaagcagtgccgggacgagaatggctttaagtgtcattgtatgtccgaatctcatcagagacaactattgctggcttcagaaaatcctcagcagtttatggattatttttcagaggaattccgaaatgactttctagaacttctcaggagacgctttggcactaaaagggtccacaacaacattgtctacaacgaatacatcagccaccgagagcacatccacatgaatgccactcagtgggaaactctgactgattttactaagtggctgggcagagaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggaggtccctacttttacggaattaagcagagaaaatgatgaagagaaagtcacgtttaatttgagtaaaggagcatgtagctcatccggagcaacatcttccaagtcaagtactctgggaccgagtgcactgaagacgataggaagttcagcatcagtgaaacgaaaagaatcttcccagagctcaactcagtctaaagaaaagaagaaaaagaaatctgcactggatgaaatcatggagattgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactggccctttaaaaggacgcagagttgaaggaattcaatatgaagacatttctaaacttgcctgagtttgaaaatttgttaacaatacattaaaatcttaaagcatcaaattggtgttcgccaaggcattatgagactctactgtgttagggtatattcttttgtataaaacaaacaggtttttgaaaatattactgtatagttgttcagctaaactttgagaagaatttaattatgtctcatgaggtatcaaactatgtaattttgtccttgttatttttgtttcctttgtaatttacttgatgagtttatatcttcattaaagaatgttattataaagtgttttatctatgacaatttagaatcatgtaattggaggaaatccttcatacactctatattttcagtagtagagtagtaaagttgaactctaagtgtgactaaattttaaatgtcaaactataaatatagaagcagctttattgtggtaataattcatataccatacagttcactcatttaaaatatacatacaattcagtggtttttagtatttttgcagaattgtgcagccatcaccactgtctgattttaaaacactttcataccccaaaatgaaaccctttaatagtcaatcgctatttttcccctctgccctagccctagacagccactaatgtactttctgtctctatggatttgccctttctggacatttcttataaatggaatcatataatatgtgatcttttatgactggcttcttacacttagcatcatgttttcaaggtttatccatgcagtagcatgtaggcgtgcttcatttgtttttatggctgcttaatattccactgtatggatgtaccgtattttgtttgtccattcatcagctgataaacatttagattgtttctactttttggctattgtgaataatgctgccatgatcacccatttacaggattttatgtgaacagaagctttcgcttctgccaaactcttccagagcagctataccattttacagtcctaccagcaatgttgaactatagttttatttgtttttaatttttttacttttagagacatggtctcactgtgttgcccaggctgctgtcaaactcctgggctcaagtgatcctcctgcctcagcctcccaaagtgctaggattgcaggtgtgagccacagcaccctgcctaaccatacagtttgaaataagtagggcagtgtattattagggaatgcaaaagacaggaaacccacatttgcctgtgccaaaggaaaaacgaagggatatttgtagtgcacatgactgaaaggagcagacgctagcttccagggcagcgggaccgggtgtgaacagccttccctgggcttccgctctgtctctggctcctgtgctggctctctacatttacattcttgagcactctaggtttacatcttacccttcagcagcaccgggaagagagagatgatctatcttttctttttctttttttttttttttctgacacagagtctcactctgtcacccaggctgattgcagtagtgcaatctcggctcactgcaacctccacctcccgggttcaagccattctcctgcctcagcctcctgagtagctgggactacaggcatgcgccaccacgcccagctaatttttgtaattttagaagagatgaggtttcaccatgttggccaggatggtctcgatctcttgaccttatgatctgcccgcctcagcctcccaaagtgctgggattacaggcatgagccactacgcctctttttttttgttctgttttttgagatagggtcttgctctgtcatccagcctggagtgcagtggcacaatcatggctcactgcagcctcgtcctcctgggcttaggtcattgattctcccacctcagcctcccgagtagctgggactacaggcatgcactaccatgcctggctaatttttttgatttttagtagagatgaggtcttgctatgttgcccaggctggtctcaaactcttgagctcaagcaatcctcctgcctcggccttctaaaatgttgtgattacaggtgtgagctaccacgccttgcctgagttgatcttctacaagagttcaaacaaaaaacagaccataccaggatgatcacttcaaacatgaggatgggtataagctgacgtcagacacaggtatggtgccaaaccctgggatctctctctttaactgagagtcagggagggctgattgcttctattctcagaagatgggagaacgtatgctgttagcagaaatgtaagaggcagtaaagaaatactaataggatgatggcagaagctttacagaaaatgttcctcagggatgaattaaggtttttccaaagtaacctgacagcacattatggaaagcaactgggttttgggtgtgggcagtctttagatcaaattctggcagttctgttcattggctttgtaatattagaatgttaatgttcttgaattgcaatgtttttaatgtataaattgtcaaaatgtttttcagcagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctgcctcccacatttaattctccaacgtctttctgaaattatttcagaatgaaatgaggcagcatacttgaggttaaattcaataaaaaatatctgaagcataaaaatacgattatagacttcacagtagttttttccctctgagtctgtagaacttgatagagtttatgctaagcaaaatgactgcagataactaacaacaggtctcatattagactttgatttttgaagtatcataagctatttttctttatttcaaacatagactttactttttagagcagtctctgtgggttttgacaaatgtataatgacatgcatctgccactgtagtatcacacagaacagtttcactgccctagaagtttcctgtgttctgtctgttccctgtctccccccaaatccctgctgaccgctgatctttttactgtctccctagttttgtctccatcgaaggtcatatagttggagtcacacagggtgtagctttttcagattggcttctttcacctggtagaacatatgcatgtaaggttcctccatgttgttttggttaggtttttgtggctcgatagcgcacttcattttagcactgcatattctattgtctgaatgcaccacagtttatgcactcacctactgaaggatatcttggttgcttacaaggtttggaaattatgagtaaagctgctacaaacatctgtgcgcaggttttttgtggatagacgttttcaacttatttacgtaacgaccaaagagcacaattgctggatcatatgccaggagtcttctgagaaactaccaacctgtcttccagagtgactgtaccattttgtattcaaacgagcagtgaatgagagttcctgctgctctgcatctccgtcagcatttgatgttgtcagtgttctggattttggccatcttaatagctgtacagtgggatcttgtcattgctttaatttgcatttctttgatgaagtatgatgtggagcatcttttcatgggcttatttgccacctgtatatcttctctggtgagatgtctttcaggttttttgcccattatttaattgggttactcattttcttattgttgaattttaagagttgtttgtatatttcagttgtgttctttatcgaatgtgtcttttgcaagtattttctctcagtcagtggcctgtcttctcattttgttttaagctattcttttttaacaccccaagattttcatcgttacttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtacatcgttacttttaagaccactgtgcacacataaaatactaaaagctaaacttaatatctgcaggtagaagttttaaattcaagattttaaccaaataacagagttaatgctaaaatctcacttttgaagtttatgttgaatattagcattctaatatttaatatttttctatttttgaaataggaaatggaaaagatgcagtaggtttttcaaaagggtatcataggtgagcacttcttatagaagaagaaaactaagaggtagtgctatttacctcttcagcactaagtttatctttatttttatttatttctataaagagatgggagtctcactgtgttgcttaggctggtcttgaactcctggcctccagtgatgctcctgccttggcctccgagagtgctgggattataggcatgaggcaccacacccagccagtaatctttagcttctagaaacaatcagatttccttaagattttgcaattaggtttagaggagctcacttgctttttcaaatatgggttggatatgtccaaaaaaagagttttgcctctacaatgaaaaatgatttttaccagattatggaaaggaagattcataaaaatgtgcctttaaaaagcttttttaaagtgcaagttcaccaatttgacttttgaaaatacgttcattttaggaattgattttttaaggaaagttgtaaacacagcaaagcacagaattacactggttcagacttgcatcttagcaccaaaatccactatacaaatgcagacagcataaagtaacctagtttcgctttaaatttgttgcttattttattctcccttataaatgtcattggtcttttgttagaacataatttactactttattttgaaataaagtctaagatttagcatgtaa

SEQ ID NO: 146608 - DNA, 817 bp, Homo sapiens
  Payload ID: 9003
  Gene Symbol: KIN
  Gene Name: Kin17 DNA and RNA binding protein
  ENST ID: ENST00000498098
  CDS Start-End: 1-327
attgaagaggaaaagaaaagaactgcccgaacagactactggctacagcctgaaattattgtgaaaattataaccaagaaactgggagagaaatatcataagaaaaaggctattgttaaggaagtaattgacaaatatacagctgttgtgaagatgattgattctggagacaagctgaaacttgaccagactcatttagagacagtaattccagcaccaggaaaaagaattctagttttaaatggaggctacagaggaaatgaaggtaccctagaatccatcaatgagaagactttttcagctactatcgtcattgaaactgtgtgagctaccacgccttgcctgagttgatcttctacaagagttcaaacaaaaaacagaccataccaggatgatcacttcaaacatgaggatgggtataagctgacgtcagacacagcagggttgatgggagacctacagaaaatacatataaatcatcagacatgaagtccagcacatagtaggtattgaataaatggcagtgagtggtcatgtccagaaatgaagccaagaagttgagcctggactactaagaatctggtctgaagaatttcaaaaaggagaatggttctccctgataacaaatagtgatgagtaaaaccagacaaattacatatgcctcccccaagtatgtacgtttggaatcaacttggtggttttcttcagagaaaaaatgtttcatgtctgcctcccacatttaattctccaacgtctttctgaaattatttcagaatgaaatgaggcagcatacttgaggttaaattcaataaaaaat

SEQ ID NO: 146609 - DNA, 7361 bp, Homo sapiens
  Payload ID: 9004
  Gene Symbol: KIDINS220
  Gene Name: kinase D-interacting substrate, 220kDa
  Uniprot ID: Q9ULH0
  ENST ID: ENST00000256707
  CDS Start-End: 183-5498
acgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagaagttatcaaggaggatgctgctgaggggctttcttcacccacagactcctcgagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgctattctgactcatgaatttttattcactatgatgattcacattttgattaaaaataaaagtagtttgtgtgttt

SEQ ID NO: 146610 - DNA, 3765 bp, Homo sapiens
  Payload ID: 9004
  Gene Symbol: KIDINS220
  Gene Name: kinase D-interacting substrate, 220kDa
  Uniprot ID: Q9ULH0
  ENST ID: ENST00000319688
  CDS Start-End: 158-3253
ggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagatgctgtggagcagacagttgtgaccgagaccgaattggcatttccaagtcagtgttagttgccatgttgatggagagctgagaaaagccattttaatggcatttgcaaataagcaggacatggaacaggccatgactccctcagagatgcacattcacttgggttatctgcctcgaaggactgaaaatggcaaatattcaaaacttcagcaaccagaggtactggccttcatgagacaacggaatgggtagttgaaacattaaagagcaaacaacagtacagtcacttctgctcctctgaaatgaagacggcctcacatatccctttggaaacaatcaagtgtgcttctcatgactaaaggttaaagctgtaagactgttggcatttactgaactgactgtgacattagtaataaatataaaaaatagatatttagttgaaagggtaattcatcttgattgagccaattgtgttctatgttgtaggacatgctgcttccctgctttcttaatgttaagtacacattccatttgtatgggatttttattcaaatagtcctattaaagtatgcacttttgttgggaaaaaacaaa

SEQ ID NO: 146611 - DNA, 5988 bp, Homo sapiens
  Payload ID: 9004
  Gene Symbol: KIDINS220
  Gene Name: kinase D-interacting substrate, 220kDa
  ENST ID: ENST00000488729
  CDS Start-End: 154-264
gaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtagagatggggtttcaccgtgttacccaggatggtctcctgacctcatgatccacccacctaggcctcccagagtgctgggattacaggtgtgagccatcgcgtccggcaagccaagctattattatttggcaggacattttaggtgctaatacagttttgtataaatatttgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcagg

SEQ ID NO: 146612 - DNA, 7248 bp, Homo sapiens
  Payload ID: 9004
  Gene Symbol: KIDINS220
  Gene Name: kinase D-interacting substrate, 220kDa
  Uniprot ID: Q9ULH0
  ENST ID: ENST00000473731
  CDS Start-End: 199-5457
agggcacgtgatctgtcagttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggttgggagaccgtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacaggccattctttgccccatacctttacacgccaaggtattaccctggcggctcccaacatctcatctcacgtccatcagtaaaaacgagtttgcccagagatcagaacaatggcctagggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcgagtctcaattcccaggattccagtattgaaatttcaaagcttactgataaggtgcaggccgagtatagagatgcctatagagaatacattgctcagatgtcccagttagaagggggccccgggtctacaaccattagtggcagatcttctccacatagcacatattacatgggtcagagttcatcagggggctctattcattcaaacctagagcaagaaaaggggaaggatagtgaaccaaagcccgatgatgggaggaagtcctttctaatgaagaggggagatgttatcgattattcatcatcaggggtttccaccaacgatgcttcccccctggatcctatcactgaagaagatgaaaaatcagatcagtcaggcagtaagcttctcccaggcaagaaatcttccgaaaggtcaagcctcttccagacagatttgaagcttaagggaagtgggctgcgctatcaaaaactcccaagtgacgaggatgaatctggcacagaagaatcagataacactccactgctcaaagatgacaaagacagaaaagccgaagggaaagtagagagagtgccgaagtctccagaacacagtgctgagccgatcagaaccttcattaaagccaaagagtatttatcggatgcgctccttgacaaaaaggattcatcggattcaggagtgagatccagtgaaagttctcccaatcactctctgcacaatgaagtggcggatgactcccagcttgaaaaggcaaatctcatagagctggaagatgacagtcacagcggaaagcggggaatcccacatagcctgagtggcctgcaagatccaattatagctcggatgtccatttgttcagaagacaagaaaagcccttccgaatgcagcttgatagccagcagccctgaagaaaactggcctgcatgccagaaagcctacaacctgaaccgaactcccagcaccgtgactctgaacaacaatagtgctccagccaacagagccaatcaaaatttcgatgagatggagggaattagggagacttctcaagtcattttgaggcctagttccagtcccaacccaaccactattcagaatgagaatctaaaaagcatgacacataagcgaagccaacgttcaagttacacaaggctctccaaagatcctccggagctccatgcagcagcctcttctgagagcacaggctttggagaagaaagagaaagcattctttgagaaaaacaagcaaaggagaagagtgttactgtacctttatgacagaattgtcctggattttgactccatccacgcccatcacctttctacattttgctgacagataactaaccgatgatgaggccgaggtaaaagagacatctgcagtgtgacagaagggagcatgagaagcatggctcaccagccagcctctgtggtctttgtaattagaagcttcagaactcactaatactactgtacctttcattggcgcattaccccataaaactttttgagacgaggtgagatctgagtataaagataggtcagaagtattttaaagggcttaatgtgccaaaaagaaaaaaagctagagaccctttttgcaaacatttggtgaccacacatttgagggaagacgtggcgttaggtgaagcagaagcaaaccctgctcttaggggctcacctaggtgagtgcacagcctgtgacgctacagggagaggctgagtaaaccgagatccagcgttctgtatggcaggggtattgcttatcacagaggttctgaagagtaggaagtacataatgaagagggctttaaaaattgccaacaaagtgagtcaccagggctggcagtagtgtgacggggctgtcctgagctgttaggagagtagatgcggggagggctggtgacctccgtgggtttatatgtcggaaactcttctctccaaatcccaggcctggcttccagcaccatccagctgtgcccaagaagccaccctggtctgttctccaactcttttaaatggtgcccaacttttctaagtgagcttagcaatgagaagaaaaaaaaacatgaattctttttctggaaaatcagggagacatgggtaataataggtactaataaatatttatagatgagtgaatgaggaaataattacatcaaaaaggtcagtgacaattgataaatgacaaggaaatatttaattaggtaaaactaaatcattgctctctatactaggatagactttatctacttcatctgttcctaagtcagcatgttagttctggggaaggatcataagaaaggaaatactttttaaaaaaaaatttggaaacatgtaacaaagcaagggtaaaatatatatatatatctatataagtgctgtgactgtaaaagtgtactttccattaattattagccgagttaagagaatggtcacattgaagtactgtgtggactagaaatgtaccctgtcatcatgcaatgaaatattgttatcgttttaacatagctcatttatgtagaatgaattctggtggtttaccccaagtcacagttaggacggtagatggtgagatcgcagatgcgctattatctagattcagtgttacattttcgatgtttatcactcagtgggtttttattaatatgctgattaagttatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcagagacaatgttttctttttcaggtgagtagttgccgcgtaatatcattggagtacattctttatactgtttgtgaaattaatactagcatattaagtgtacaaatagatttagaaaacaataaaaaattgcatgcta

SEQ ID NO: 146613 - DNA, 2036 bp, Homo sapiens
  Payload ID: 9004
  Gene Symbol: KIDINS220
  Gene Name: kinase D-interacting substrate, 220kDa
  ENST ID: ENST00000459813
  CDS Start-End: 1-456
attccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggaaaatggagcatgaacctggggttacactttctggaactgttctcttaagccattctttgccccatacctttacacgccaaggtattaccctggcggctcccaacatctcatctcacgtccatcagtaaaaacgagtttgcccagagatcagaacaatggcctagtaagtatataaaagggtaacgcaaatattaatttaataataaacatagatagcatttgaggtttggttatttcctttacatagtaaaagagtgcaactgattttatacatagttttaagaaacaacctattactaacataaaatgtatttattttcatttctggtaaatatctatggaaggaaaatgactagcagtctcagcgaagaaatgttgacttgtttatagccagaaatttctggcttgtaatatagtgtttgctaccaaaacttttaaaactaagcctttacatttggtaatttctaatatcttcttaaagaacatgtgtatacagtacctttatagtatgtaaatattagcaccatgatataaaaaatagaggatgtattgaaggaagaacatttcaatcaaatggcaggaattaaacaagataagggaaattcttccaatgaactattgaatctaagaaagacatttgtgcccaaaatattagaggttcctgatgataaaagtaatagtttaaaaaaagaaactctctattaatatgtttttataaatcaggaggcaaaaacataaactgttgagtttcagtgttgtatattattttaccatcatgttcatttgtcttcacagtttggctccccccttccccttttcacccacactctcctgttttgtgttgttaggaagttatcaaggaggatgctgctgaggggctttcttcacccacagactcctcgagggtaatggagtagtcctgtggtgtggatcgctggcatctcattgcttctgcctcagtaatgactgtcttaattgtgatgatagcagctcactaactctgcgtttgtggtgtgatgagcagctagtgtagagtagctgaatgctaataattatggttcctgaattaattaaaaagcggatgtttaacttcacccattatttcctcctgcttttcccctttttcaatacatgggatggggtttttttttattcttcaataaggaagggctttttctatcagctgtcaggggtgttccgttggtagtatttgctcctcagtgtgagctctagctttgcctttgactgtttttgttaagcctgtggttgctattacacatgtggaatattttagaaaagtatccagtatcacccttgagactacaaaaagacacataagctagatggtgtagactaaaaatgcatctttaataactcaatctaggtgtctacatttagttaagtcttagtctgagttttagtgcagtgttataatacttttctttgtctatatatttgttaaaataaattttccagataaacagaagatcgttcagcatgtaaaagaaattatttatttatttatttattttttgccaacaccttaaggtaggtttctttaaaaaaaaaaaacaaaaagaaaaaaacaaaaaa

SEQ ID NO: 146614 - DNA, 4084 bp, Homo sapiens
  Payload ID: 9004
  Gene Symbol: KIDINS220
  Gene Name: kinase D-interacting substrate, 220kDa
  ENST ID: ENST00000489024
  CDS Start-End: 170-4084
gttcgcggagagggaagaatatggccgccgggtgtggtgagggcgacgcgcttgcagtcgccgtctcttgcttccccgtcctctgacatcgcctgcagccgagcgggcccgttccgccggagctgaggaccaggtattcaaataaagttaattgcagctttctgtgaaaatgtcagttttgatatcacagagcgtcataaattatgtagaggaagaaaacattcctgctctgaaagctcttcttgaaaaatgcaaagatgtagatgagagaaatgagtgtggccagactccactgatgatagctgccgaacaaggcaatctggaaatagtgaaggaattaattaagaatggagctaactgcaatctggaagatttggataattggacagcacttatatctgcatcgaaagaagggcatgtgcacatcgtagaggaactactgaaatgtggggttaacttggagcaccgtgatatgggaggatggacagctcttatgtgggcatgttacaaaggccgtactgacgtagtagagttgcttctttctcatggtgccaatccaagtgtcactggtctgcagtacagtgtttacccaatcatttgggcagcagggagaggccatgcagatatagttcatcttttactgcaaaatggtgctaaagtcaactgctctgataagtatggaaccacccctttagtttgggctgcacgaaagggtcatttggaatgtgtgaaacatttattggccatgggagctgatgtggatcaagaaggagctaattcaatgactgcacttattgtggcagtgaaaggaggttacacacagtcagtaaaagaaattttgaagaggaatccaaatgtaaacttaacagataaagatggaaatacagctttgatgattgcatcaaaggagggacatacggagattgtgcaggatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcagtcacaaactcgcagaaccccaagtctttcg

SEQ ID NO: 146615 - DNA, 3220 bp, Homo sapiens
  Payload ID: 9004
  Gene Symbol: KIDINS220
  Gene Name: kinase D-interacting substrate, 220kDa
  ENST ID: ENST00000496383
  CDS Start-End: 1-3174
gatctgctcgacgctggaacatatgtgaacatacctgacaggagtggggatactgtgttgattggcgctgtcagaggtggtcatgttgaaattgttcgagcgcttctccaaaaatatgctgatatagacattagaggacaggataataaaactgctttgtattgggctgttgagaaaggaaatgcaacaatggtgagagatatcttacagtgcaatcctgacactgaaatatgcacaaaggatggtgaaacgccacttataaaggctaccaagatgagaaacattgaagtggtggagctgctgctagataaaggtgctaaagtgtctgctgtagataagaaaggagatactcccttgcatattgctattcgtggaaggagccggaaactggcagaactgcttttaagaaatcccaaagatgggcgattactttataggcccaacaaagcaggcgagactccttataatattgactgtagccatcagaagagtattttaactcaaatatttggagccagacacttgtctcctactgaaacagacggtgacatgcttggatatgatttatatagcagtgccctggcagatattctcagtgagcctaccatgcagccacccatttgtgtggggttatatgcacagtggggaagtgggaaatctttcttactcaagaaactagaagacgaaatgaaaaccttcgccggacaacagattgagcctctctttcagttctcatggctcatagtgtttcttaccctgctactttgtggagggcttggtttattgtttgccttcacggtccacccaaatcttggaatagcagtgtcactgagcttcttggctctcttatatatattctttattgtcatttactttggtggacgaagagaaggagagagttggaattgggcctgggtcctcagcactagattggcaagacatattggatatttggaactcctccttaaattgatgtttgtgaatccacctgagttgccagagcagactactaaagctttacctgtgaggtttttgtttacagattacaatagactgtccagtgtaggtggagaaacttctctggctgaaatgattgcaaccctctcggatgcttgtgaaagagagtttggctttttggcaaccaggctttttcgagtattcaagactgaagatactcagggtaaaaagaaatggaaaaaaacatgttgtctcccatcttttgtcatcttcctttttatcattggctgcattatatctggaattactcttctggctatatttagagttgacccaaagcatctgactgtaaatgctgtcctcatatcaatcgcatctgtagtgggattggcctttgtgttgaactgtcgtacatggtggcaagtgctggactcgctcctgaattcccaaagaaaacgcctccataatgcagcctccaaactgcacaaattgaaaagtgaaggattcatgaaagttcttaaatgtgaagtggaattgatggccaggatggcaaaaaccattgacagcttcactcagaatcagacaaggctggtggtcatcatcgatggattagatgcctgtgagcaggacaaagtccttcagatgctggacactgtccgagttctgttttcaaaaggcccgttcattgccatttttgcaagtgatccacatattatcataaaggcaattaaccagaacctcaatagtgtgcttcgggattcaaatataaatggccatgactacatgcgcaacatagtccacttgcctgtgttccttaatagtcgtggactaagcaatgcaagaaaatttctcgtaacttcagcaacaaatggagacgttccatgctcagatactacagggatacaggaagatgctgacagaagagtttcacagaacagccttggggagatgacaaaacttggtagcaagacagccctcaatagacgggacacttaccgaagaaggcagatgcagaggaccatcactcgccagatgtcctttgatcttacaaaactgctggttaccgaggactggttcagtgacatcagtccccagaccatgagaagattacttaatattgtttctgtgacaggacgattactgagagccaatcagattagtttcaactgggacaggcttgctagctggatcaaccttactgagcagtggccataccggacttcatggctcatattatatttggaagagactgaaggtattccagatcaaatgacattaaaaaccatctacgaaagaatatcaaagaatattccaacaactaaggatgttgagccacttcttgaaattgatggagatataagaaattttgaagtgtttttgtcttcaaggaccccagttcttgtggctcgagatgtaaaagtctttttgccatgcactgtaaacctagatcccaaactacgggaaattattgcagatgttcgtgctgccagagagcagatcagtattggaggactggcgtaccccccgctccctctacatgagggtcctcctagggcgccatcagggtacagccagcccccatccgtgtgctcttccacgtccttcaatgggcccttcgcaggtggagtggtgtcaccacagcctcacagcagctattacagcggcatgacgggccctcagcatcccttctacaacagggggtcaggcccagccccaggcccagtggtattactgaattcactgaatgtggatgcagtatgtgagaagctgaaacaaatagaagggctggaccagagtatgctgcctcagtattgtaccacgatcaaaaaggcaaacataaatggccgtgtgttagctcagtgtaacattgatgagctgaagaaagagatgaatatgaattttggagactggcaccttttcagaagcacagtactagaaatgagaaacgcagaaagccacgtggtccctgaagacccacgtttcctcagtgagagcagcagtggcccagccccgcacggtgagcctgctcgccgcgcttcccacaacgagctgcctcacaccgagctctccagccagacgccctacacactcaacttcagcttcgaagagctgaacacgcttggcctggatgaaggtgcccctcgtcacagtaatctaagttggcaggaagaaaatgctggccttgagatagatagctcttcagaggatccagattaaactaagttcgagtcacttctcacagttgacttcctcaccaaataat

SEQ ID NO: 146616 - DNA, 5831 bp, Homo sapiens
  Payload ID: 9005
  Gene Symbol: KDR
  Gene Name: kinase insert domain receptor
  Uniprot ID: P35968
  ENST ID: ENST00000263923
  CDS Start-End: 297-4367
tcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaa

SEQ ID NO: 146617 - DNA, 6793 bp, Homo sapiens
  Payload ID: 9006
  Gene Symbol: KNDC1
  Gene Name: kinase non-catalytic C-lobe domain (KIND) containing 1
  Uniprot ID: Q76NI1
  ENST ID: ENST00000304613
  CDS Start-End: 22-5271
ggtgcgcggcgcggccgcaggatgcaggccatggacccggccgcggcggatctttacgaggaggacggcaaagacctggacttctacgacttcgagccgctgcccaccctccccgaggacgaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggtcatgtacgcggaacgctggggcctggagccctgcaccctcccagtgatcgtgaacatcgcggccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccagtgatgccttcctggagggttatgtgcagcaattcctctacaccttccgctacttctgcacaccccacgacttcctgcacttcctcctcgaccgcatcaacagcacgctgaccagggcccaccaggaccccacctcgaccttcaccaagatctacaggcggagcctctgcgtcctgcaggcctgggtggaggactgctacgctgtggacttccctcggaacagcgggctgctggggaagctagaggacttcatctcctccaagatcctacccctggacggctctgccaagcacctgctgggcctcctggaggtgggcatggaccggcgggccgagggcaaccctcgcggcacagacctggagaaccccagggaggccgaggaggatgccagacccttcaacgccctctgtaagaggctctcagaggacggcatctccaggaagagcttcccctggaggctgccccgaggcaacgggctggtgctgccgccacacaaggagcgcccctacaccattgctgccgccctgcccaagccctgcttcctcgaggacttctacggcccctgcgccaagaccagtgagaaggggccctacttcctgacggagtacagcactcaccagctcttcagccagctcacgctgctacagcaggagttgtttcaaaagtgccacccggtccacttcctgaactcacgggccctgggcgtcatggacaagagcactgccatccccaaagccagctcttctgagtctctttcggccaaaacctgcagcttatttctgcccaattacgttcaggacaagtatctgttacagcttctaagaaacgcagatgacgtcagcacctgggtggctgcagagattgtgaccagccacacctccaagctgcaggtgaacttgctgtccaaatttttgctgattgcaaaatcttgctatgagcagagaaacttcgcgacagccatgcagatcctgagcgggctggagcacctggccgtgaggcagtcccctgcctggagaattctgcctgcaaagatagcagaggtcatggaggagctgaaagccgtggaggtcttcctgaagagcgacagcctgtgtctgatggaagggcggcgcttccgggcgcagcccaccctgccctcggcccacctcctggccatgcacatccagcagctggagacaggcggcttcaccatgaccaacggggcccacaggtggagcaagctcaggaacatcgcaaaggtggtgagccaggtgcacgcgttccaggagaacccttacaccttcagccccgaccccaagctccagtcgtacctcaagcagaggattgcccgcttcagcggtgccgacatttccacactcgccgcagatagcagggccaacttccaccaggtctccagcgagaagcactcacggaagattcaggacaagctacggaggatgaaggctacattccagtagccgagctcgggcctggtgtggaattccagatccgaatccgactgtggggggcgggctgggaggtgggagccgcgtctcaggcccggccgttatcaaggcccctccgcccccgaaccctggggagctggaccaggaggtggaggctcaggggaccccatggggacaggcagagctggtctcctcccagcagacggagccaggacgggcacaagagtcttggaggtttgcgtgtttctgctagaattaaaaagttaaatttaaaaatgaaaatgaaagacagcttcccaggagttttgtgcctgtctgcgcctctcacacacagataagtggctcttacccagctctcagtgactcccccacaaaacagcaacagcctccaccgccaactcaacaaacttcagagtagctcctccctgagcaggtttctgagccagcctgggttggctgagcaacgaagggccaaagctgacctctgagtggccaactgcagctcccagggactccgagacctccggtccgagaccctgcctgggttcaccccccacaacccagacccagaaccgctctccccttccctgcccagtgcccctcctccccagcccagacccccaggtgcccaaggcctgctgctggagcaggcaccttgggctgggcctgctcccccagggcccagggccccccagcttagaacagcccttggtgaggtggtcatgcccgggcaaaggccctgcttcctggaaaggacactcagagcagctccaagacagaggctctgtggcgggggtccctgagagtgcccccacccatctcatgccccagggaccgccactgcccaccgcctccagcagccatgcatgtgcgcccgcagccctgcctccacagctcgccacacactcacgcttcgccagagacaggaagtgcgctgcctccacggccccttgcccttgctcaggttcttggaccccaggcagctggtgtggagccccttggccagggccatgggagtcccgcgcagtcagctccacattggcctctgcagctgggtgaccagagccccgggcacggccccagctccgtggggctctcacggtgccaatcacaagacccagggttgtgcttttgagttttagaattagtcattctttagagcagccagctagtggcatttctaggaaaactgtgacctgtgacaaatcgctgcatttttaatgtcaagatgtgttttcccacataaattcaccggagacatccgggccccgcttcgatgtaacatgagaggaagtcggcgtcctggccacgaaatgcagttcacttttttttaggcttttatatggattatgttttgctgacccacgcccgcattttcagattttgtatctaacagacagtgctcagtgcaaatcaacattccagcggtcaggactgaccccggggcagcactgggctcaggcttcagcgcgactgtccgcatggctccctcccgtcctggcaccaatttctgaataaagtcctttctaccagc

SEQ ID NO: 146618 - DNA, 3925 bp, Homo sapiens
  Payload ID: 9006
  Gene Symbol: KNDC1
  Gene Name: kinase non-catalytic C-lobe domain (KIND) containing 1
  Uniprot ID: Q76NI1
  ENST ID: ENST00000368571
  CDS Start-End: 291-3716
gttccgtggctctgacgtccagggaacagcaggacgactcttgaaacaaaatgagacgtggtctaaagccctttccctgacccacgcgttgaaacgctgccacgagtcgtccgtttccccagggaatcgtctcggtgggggtgccggggcctggctgggggtcctgccgggctcacggccagggccggtcttggcaggagaacgtgtctctggctgacatcctctccctgcgggaccgcggcctcagcgagcaggaagcctgggccgtgtgcctggagtgcagcctgtccatgcggagcgtggcccacgccgccatcttccagagcctgtgcatcacgcccgacaccctggccttcaacaccagcgggaacgtgtgtttcatggagcagctcagcgacgaccctgagggtgccttcgttccccccgagttcgacgtgaccgggaacacctttgaggcgcacatctactctctgggggccacgctgaaggccgccctcgagtacgtggcagagcccacactggaacccaggctgagccaagacctcgaggcgctgctgagccggatgcaggcggaggaccccggggaccggccggaccttgagagcatcatcgcgctgtgtgaagagaagctgcagctcacatcctcctgtcgcgtgtgccggagcctctctgctgtggggaggagggtcctctccatcgagtccttcggagcgctgcaggatgtcagcgagagcagctggcgggagagacctgccccaggaaacgctgggcccaggaggccgcccggggaccccagcactgacccggaggttctgccgacccccgaaggcccggagtctgagacgagccggggccccagagcctccccaaccaaggctctgctgtccaccccggtgagaaatggcgagagccacagccgggaggggctggccggcctcgtcctggatgccgagcgcaccctcggggagctggacagagacgccctcaggagaagccgcctgcggaaggtgcagacgttccctaggctgctgtccgacagccccgaggccaccctctgcctgccgctgacccgcgggaaaagccagctgcccatatcggaattattctctccggaccccaggaaggcctttctggacaggaaaaatggcctttctagcttccaggctcagcccaaatgcaggctgtggccggagcaggagccggaacaccagctgggacgggttccctgtgcaggccgcagcacggacaggggccctggggtgcccggcagtccaggacagcccgagacttcacaccccagccaggggccagcagaggcccctgcagaccctcgagatgctagcggtgaagcccagactcccagggacgatgagagaattccagaaggagctaggcagctggaaagtgcagccgcggagcagtgggtgtccctgcaggacctcctgtcccagctgggccggcccttccgggagtacgagctgtgggccctgtgcctggcctgcctccgcgcactgcagacacgccctgagcacccagcctacctgtgtctggactccgtgctggttgctgaggacggggctgtgctcttccagccaccccctgccaacggttcctatgactcgttctttctggctcccgagctggcagaggagaggctggtaactgaaaaggcctctgtgtactgtgtggccgccgttctgtggaccgcagccaagttcagcgtcccccgcaaccacaagctggccctgccacgcaggctcaagaccctcctcctggacatggccaggcgcagtgccccggagcggccgtccgcggctgaggccatcaaggtgtgcggcagctacctcctccagcgaggcatggacagccggaaaatccttgcccacctcagagcttccatctgccaggtgtaccaggaggaagagaccatcagcctccaaaacgccttctcagtggttgaactgaagcccagtgtggcaccagccccagagcccagcccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccagggaccagcctgccttggcccaggaggagtccgaggagaggggcggccagagggagggagaaggtgaggagaagctctccctggaggcccacgctgggtcccccagcctgaagacgcctgacgggccggtgcctggtccggggccacagggagcagccccagagcctcttggggcgtcagtgcagcgtgactcagcccagggccgcccctgccctccaccccaggccccagcaaaccagccagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggaggaatttgccttcgatggctacctggacaatgggctggaggctctgatcatgggggagtacatcttcgccttgaaagatctcacctttgccactttctgtggcgccatttccgagaagttctgtgacctgtactgggatgagaagttgctgcagaacctctttaaggtggtcaacgggcaggcgtcaccctccccaagcacggccgaggaggctgggtcacagctcgagggcagccaaagcccccgctccccgtccagcaagaggccgtcgctgcaccgcctgggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggagctggaacagcagctcatgatggagaaaagaaactaccgcaagaccctgaagttctaccagaaactcttacagaaggaaaagaggaacaaaggttccgacgtcaagaccatgctgtccaagctgaaagggcagctagaagaaatgaaatccagggtgcaattcctcagcttggtcaagaagtatctgcaggcaagtgggctccgggccccgctctgccccgtgaggcagtagcttcagacgggcctcccactgttggatgctgtaaatctgtccgtgtgaagttataaaaggggccctgatttgagggtccaatgccaggaagccctggggcgaggggcagagtgaccaagcgcccgtgtcccgctccggcaggtcatgtacgcggaacgctggggcctggagccctgcaccctcccagtgatcgtgaacatcgcggccgc

SEQ ID NO: 146619 - DNA, 2806 bp, Homo sapiens
  Payload ID: 9007
  Gene Symbol: KSR1
  Gene Name: kinase suppressor of ras 1
  ENST ID: ENST00000268763
  CDS Start-End: 266-2806
ctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtag

SEQ ID NO: 146620 - DNA, 2048 bp, Homo sapiens
  Payload ID: 9007
  Gene Symbol: KSR1
  Gene Name: kinase suppressor of ras 1
  ENST ID: ENST00000398982
  CDS Start-End: 1-1839
cacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcactaacccaggggatgccacctctgctgctccagtcgtctctctcgaggctacttcttttgctttgttttaaaaactggccctctgccctctccacgtggcctgcatatgcccaag

SEQ ID NO: 146621 - DNA, 7237 bp, Homo sapiens
  Payload ID: 9007
  Gene Symbol: KSR1
  Gene Name: kinase suppressor of ras 1
  Uniprot ID: Q8IVT5
  ENST ID: ENST00000398988
  CDS Start-End: 446-2734
ctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcactaacccaggggatgccacctctgctgctccagtcgtctctctcgaggctacttcttttgctttgttttaaaaactggccctctgccctctccacgtggcctgcatatgcccaagtaactgctctcagaggatcccactaactgagctccctccaaggcagtctgggcagcttctaactaccttcctggacatgactgattgctcccgtgttcttctgagggctggtcttgtttttgtttgggtggctctgtctcactgctaacaccttagtgagatgccttccaccctcctgagcacaccagcctcccactgggtgtgtgcctagtgcggggcgggcggaggttgggagggtgttggcttggcttttaacctgtggggattttgtccaacaaggagtggaatgatttcagagctgccctgaggctggcaccctggtcacaggaaccctctgcgctggctcctgtctcagtcccctctgtagagttagatcagaagacacagaaagttctgtggccatgaaagataccagcttggaagggttgtgtcttcagtggcaccctcagaaaaattgtcttaaagcaaagaggtacctggctccagacaatttttctgatgaaaacaaagtctctgccccgtccccaccctgccaccctggcaaagttacttcctttacagctgcccagtgtaccatagaccagaccccaggtcagcatttgtcaagagcatggctgctgagtcccctgtggcagtcaatgcactgtttaccaaatgcaggtttctgttctccctccccagcaagacctgctgaacccagatctctggaatggggccctaggaatttgcatttcaacctgcttcccaggtggccctgatgcaccccagtattagagtttattgctaaaaggaacatgccctgtcactcctggtatcctgggagtcatgtttctcttctctctcagttctacttggagcaagagctttcctgggctgcaaatgagaaaacaattcctaggaacccacagcagtactgagcatgctgggagcttgggacttggagatgaatgagccaccgttgctgctccaagtaggactacttggagtgtagctgaggccttggacgcagtatgaccaggggcagctctgccagggctgttggccaatcagtcattttcatttcttgttggaggccaggtcctctgctgaactcatttcctagctagtgttaccctaattctgatgaagatcaatggggctataattcttgtttttgttcctctttgcagcattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactggcactgacggccaggatggcggaaatggccatcccctctgaggaccttgtaggcggtgagggacccatgctgggccagaaggaagacaaacatggtaattgcagctgttcttggggtagggcggggagcccagaaggtctgatctggcctctgctttttggcccaagactccatcagggaaatctatctagggctctccccttgtcctttcaaagggatactgccccttcctcgtcttgcagaggaaaccctggctaggaactgagctagtttatggagtctggaattcctggagagcttgggttcaccttctcacccctgtaatccaggctgctcctgctggaaaagtagaaacagaatccaaaaaaggtctggactcacccggtggttcccagccagggtttctgctgcaaggtgaggaaacatccatggcttgtacagatgtgagtctttgatgaagcccccaggcaggcaccaaggtgatgggactcagggccttggcttttagatacatcccagtccctgactgacatctgaccatgagggctggatgggtgggaacaaggaggagtagatggcaaaagtacctgagcccacttcccagccacagggtgaccctggcactgtaaaaaccctttgtcagtcatgccagaaggttctagaactgcccacctcttccatttcagtcctgctgaaaccccttagcctatttccgactcctctgtccatgctctgagttcagctgggcagtgtgtgggctatcacccctttcatttagacctacctagctggcccccatctgcagagccttccttagcaccattaggccttctacttgtgtccatttgaagcaggaggggctggatttggaaaagtctttgaagtgagagcaccacgcttgtcttcgttagaaactcttaactgcagaaaaaagttccagatggcaagggagcccttaagtggagattaggttgcattagactccaaaaccagaaaggaaaaagggtgatgggagtggagacgtgattggattcaggcccagaacctgtgaccatgctctgagctcagacttggggagggaggggtgtggctcccaccccttccagttaagacctgcctagcagagccccagtctccagccccttccctagcaccagagtctggtcaaaatgccacagaaaatgagctgctctgccagcaagctgtggagctgcctcctctccaggcctggcatcccttggtcagcccctcctgggagggcacagccgtattacagtgccagtgtgcctggccatcagcatcttcacccttcccagtctgtgtggggaggctgtaaaccccgtggattcagctccgtgtggagtttctgtgctatggtgggactgctcattttgccccatcatccctttggcctcccacacacctgccccttcccagggatcacgtgtgtctccagcctttcacctttctattgcaatggtggcctttgtccaggcaagagcaggcctgatggatgtactggtgagccccacagttggatgtcagctcagccgtccaactgggaggaacagtaggctcagttcctccctgacccctgacaccaggccgcagtgggcatgcacaggcccacagaaagtcagtctgggttttgcttttctcgtgagcatcacagttaaagaagcgctcattgagcaactacagtgcacttggtcttctgcaagtgctgggcacctagagataggaacagtcatggtccctgctcttaaggaactgatgacctggtggggccctgttgtcttcaaggaacccagaagccactgggccccaaaggtggaactgaaggactgggggcagctggctctcagcctgccacctctgcactgcctgcctttaaagaaccccaccccaccccatgatggccccctctgttccccttgtatttcagtgactgtgaattgaggttaggaaggcacacctgcccttctgtgtgctctctccacacgaaggatgacagatactgtgaattcagccctcacggccaactgtgaaggggatggagaaggctgggagggctcggggagagctcttaggggctgcggaagtccccacgggggtctgagagtggagcccaagctttggccctccaggcatccccagtttccagcctcacctctgaagccctgctgcctttaaccaccagagccgcagccccctgggtttctgtctaactcgaagtcttgaatcctagctagtttggggttgtgagcagtgtgtagcaaagttgatctctccatgtcaccaaatcaaaacaccctctgtcatcctacggcatttcctcttgaggtcacagagaggaatggcaagccctggaaacctgtgttattctgtgttgatttggtgtggggggagggtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtgttc

SEQ ID NO: 146622 - DNA, 2731 bp, Homo sapiens
  Payload ID: 9007
  Gene Symbol: KSR1
  Gene Name: kinase suppressor of ras 1
  Uniprot ID: Q8IVT5
  ENST ID: ENST00000509603
  CDS Start-End: 446-2731
ctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggtacatcctctcccaaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaagggcatgggatatcttcatgccaagggcatcgtacacaaagatctcaaatctaagaacgtcttctatgacaacggcaaggtggtcatcacagacttcgggctgtttgggatctcaggcgtggtccgagagggacggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagctg

SEQ ID NO: 146623 - DNA, 479 bp, Homo sapiens
  Payload ID: 9007
  Gene Symbol: KSR1
  Gene Name: kinase suppressor of ras 1
  ENST ID: ENST00000580163
  CDS Start-End: 342-479
cggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttgg

SEQ ID NO: 146624 - DNA, 685 bp, Homo sapiens
  Payload ID: 9007
  Gene Symbol: KSR1
  Gene Name: kinase suppressor of ras 1
  ENST ID: ENST00000577823
  CDS Start-End: 1-296
aggtcttccagctgctgcccagcttccccacactcacccggagcaagtcccatgagtctcagctggggaaccgcattgatgacgtctcctcgatgaggtttgcctgccttcttcctcatctggaaacatcacaggggcagctgactgagccatcctcagaggccaggagcaagctagaggaccaagcgaggcgaggggaaccacaccatgccactgggctagcctggcctgctcctgtgttgatggacatagatcagggagatgcttatataataaaccattgcgcccccctctagcctgtggtctctgaattaggaagtcatgggcacgagctgtcgcctgcggagttcctcagcctgcccatccggcctctttccctgcagatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagca

SEQ ID NO: 146625 - DNA, 748 bp, Homo sapiens
  Payload ID: 9007
  Gene Symbol: KSR1
  Gene Name: kinase suppressor of ras 1
  ENST ID: ENST00000578981
  CDS Start-End: 179-571
tttttattttcggggggtggcggatgtgctgttctgtcatctcccactttcccatcacctgattcctccacctgtccacacgtgcctgactccatcacatgccggggccggactgcgctcttcccacgcctggtggaatggtcgctgggcactcccagtcgctggaggagccgctactatggaaaaggacgctacggccaccctgactttaagagctcctgtccgattctggaggaatacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcagatgcactggcactgacggccaggatggcggaaatggccatcccctctgaggaccttgtaggcggtgagggacccatgctgggccagaaggaagacaaacatggtaattgcagctgttcttggggtaggg

SEQ ID NO: 146626 - DNA, 483 bp, Homo sapiens
  Payload ID: 9007
  Gene Symbol: KSR1
  Gene Name: kinase suppressor of ras 1
  ENST ID: ENST00000580430
  CDS Start-End: 1-420
cgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgacattaacagcagcaaagttgtaccccggtttgaaaggtttggcttgggcgtcctggagtccagtaatccaaagatgtagccagccatatggtttttcgctgctgatctctttctttttaaaatgtgtttctgaaacatccca

SEQ ID NO: 146627 - DNA, 1041 bp, Homo sapiens
  Payload ID: 9007
  Gene Symbol: KSR1
  Gene Name: kinase suppressor of ras 1
  ENST ID: ENST00000583370
  CDS Start-End: 576-1041
ggcacctggacccctgccagggaaggggtcctcagacttgaggttgccagctcagatgtggggctgctgatactaggtgactggactgatgttctgttctagatgaaactccttgaggggaccatttgaaaaggcttgatgtgctgcccaaagcccccttcagagctgacttctccacccccagctgccgtgagccttggctgctgacagctcatagctgagtccctcccgtgaagtcaccttctgctgaagggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcagcccacacaagatgtgatcagctatccattgttactgagagatgggagttttaaatttttcaacaccaagcaagtacagaagtgttagaaagcaagcaaaggccctcctcttccacttcgcggggataacaccttgttaacaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccaccca

SEQ ID NO: 146628 - DNA, 2392 bp, Homo sapiens
  Payload ID: 9007
  Gene Symbol: KSR1
  Gene Name: kinase suppressor of ras 1
  ENST ID: ENST00000582410
  CDS Start-End: 292-633
attcttgccctgcttttctagaaacaaccggtcatgactcctttgtagaattcctcaaaagcaccggtgcctttcccaagtgcagggtcagtgttctgggtctgggtgtgttttctaagctgtgtgtgggtgttctgccggccctggggcagacctgtgccaggcaggcctctttgctgcctgctgaaaggcctgtgtccttgtcccggcttcctggtctccaggcgtgagaaccagctaaagctgtcccacgactggctgtgctatctggcccctgagattgtacgcgagatgacccccgggaaggacgaggatcagctgccattctccaaagctgctgatgtctatgcatttgggactgtttggtatgagctgcaagcaagagactggcccttgaagaaccaggctgcagaggcatccatctggcagattggaagcggggaaggaatgaagcgtgtcctgacttctgtcagcttggggaaggaagtcagtgagatcctgtcggcctgctgggctttcgacctgcaggagagacccagcttcagcctgctgatggacatgctggagaaacttcccaagctgaaccggcggctctcccaccctggacacttctggaagtcagctgagttgtaggcctggctgccttgcatgcaccaggggctttcttcctcctaatcaacaactcagcaccgtgacttctgctaaaatgcaaaatgagatgcgggcactaacccaggggatgccacctctgctgctccagtcgtctctctcgaggctacttcttttgctttgttttaaaaactggccctctgccctctccacgtggcctgcatatgcccaagtaactgctctcagaggatcccactaactgagctccctccaaggcagtctgggcagcttctaactaccttcctggacatgactgattgctcccgtgttcttctgagggctggtcttgtttttgtttgggtggctctgtctcactgctaacaccttagtgagatgccttccaccctcctgagcacaccagcctcccactgggtgtgtgcctagtgcggggcgggcggaggttgggagggtgttggcttggcttttaacctgtggggattttgtccaacaaggagtggaatgatttcagagctgccctgaggctggcaccctggtcacaggaaccctctgcgctggctcctgtctcagtcccctctgtagagttagatcagaagacacagaaagttctgtggccatgaaagataccagcttggaagggttgtgtcttcagtggcaccctcagaaaaattgtcttaaagcaaagaggtacctggctccagacaatttttctgatgaaaacaaagtctctgccccgtccccaccctgccaccctggcaaagttacttcctttacagctgcccagtgtaccatagaccagaccccaggtcagcatttgtcaagagcatggctgctgagtcccctgtggcagtcaatgcactgtttaccaaatgcaggtttctgttctccctccccagcaagacctgctgaacccagatctctggaatggggccctaggaatttgcatttcaacctgcttcccaggtggccctgatgcaccccagtattagagtttattgctaaaaggaacatgccctgtcactcctggtatcctgggagtcatgtttctcttctctctcagttctacttggagcaagagctttcctgggctgcaaatgagaaaacaattcctaggaacccacagcagtactgagcatgctgggagcttgggacttggagatgaatgagccaccgttgctgctccaagtaggactacttggagtgtagctgaggccttggacgcagtatgaccaggggcagctctgccagggctgttggccaatcagtcattttcatttcttgttggaggccaggtcctctgctgaactcatttcctagctagtgttaccctaattctgatgaagatcaatggggctataattcttgtttttgttcctctttgcagcattaacagcagcaaagttgtaccccggtttgaaaggtttggcttgggcgtcctggagtccagtaatccaaagatgtagccagccatatggtttttcgctgctgatctctttctttttaaaatgtgtttctgaaacatcccaacaaccaccacgacaaaaaaacactgcctgcccagcgctgcaaaccaggagcacacgtcctagattcagactgttggccataaaccccactcgggagatggagctgcacctgctatttcttaaaatgacaccaccaacaaccaaacctgtcatgacagacagcaaatgtttacacgtatatttctcctgagtgaacctgatgttttacaataggtaataataaaaacagtctgtgcaga

SEQ ID NO: 146629 - DNA, 17726 bp, Homo sapiens
  Payload ID: 9008
  Gene Symbol: KSR2
  Gene Name: kinase suppressor of ras 2
  Uniprot ID: Q6VAB6
  ENST ID: ENST00000339824
  CDS Start-End: 729-3581
aggcaagatgtcggtgtggagcgaggcaggagcgattgcagcaaccgtcacccccggagcccggcggcggcagcagcagcagcagcagcagcgcggggaggagacagcagccagccgcagtagccgccgcagccgcgggagcaatgcagacagcaccttgagaacgcgctaaagcactccaaaccgtggaccatgccgtgtccctgcaactgggaggggggaaaaccagattttttttgacataaaagcaagccagccaaaaatatataattttgtccttcaaggagccggtgtgtaaagagtgagcgctattttccttctcctcctcctcctctccctcctcctcctctccctcctcctctctctcctccttctcctcttctttttcctcctcctcctcctccctaagtgtacagacagcatcacatcacctggtttgcttctgagaaacagcatctctccttttcagggaccagagactcagagagagaggagacattctaatggagtccgcttgatatcccaaaataaaataataaattttggctcttgtcccctcctcccactcccaccccctcaaccctgtgtgagatgttggatttcttcttcatgagacattgttgagaagtcgcagtggttggagaggcggagggtagactacctctactcccccccctcttttttctctctgggaggaggaggaggggaagggggttgcagagcaagcgatggatgaggaaaacatgacgaaaagcgaggagcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggtgatgcgttattgatcagtgcggcccaggggacagcactaatgagagcactgcaggctgcacgtggtgcctttgggctatgggactaggacaggagaccccacgtgggggggctcacagacggggctatgtgtgtgtgtgtctgtgtgtttgacgttgttcactcttgtttccccttgacaagcaagagccagactgtcccaatgacggggcactcctcagttctgtctgtatgtggtaggttccagctgtaccatctgggaagctaagaggagggtacagagccgagtggcagcttagtcaaggctactgagccaagatcgagcagggaaggtcgggagtggctaagctcgttcctttggaaatatctgttttcagacaccccaacccgagcctgtcatggcgtgtggcacctttgcatagagctctgaagtacagtaggaaagttagaacgtcttttgagttctgggtctctctgggggacctattcccccatttctgctgttttctcctgttctctgagagtagcatcccttttcacctcactgcccgcacctccttgccatttggaaagccaagatgacttctgaggggctccttagagctcaccgtcattcagggcaccccctgaagtctggtccctgagaatcagggctctgggcagggagttctaggacattccttttcttccctcttctctgctactcacaccagtgaagcttattcccccaccaaggtggatgcgggttcttggggtacgtccatgttgggttatgtggctgtacctatgataacacgtttgcaaaagatttccctgcctgtcacccttgaggagtcctgttgggggagcacaaagggaggatgtttgttacacttctgcgttctttgctctagcctggtgcggggtcctcaagtagcttccccatcggaagcctgtgtccctcacctgtgtgtgttccctcagtgccccaccttccctccctcctcttgatcccaacctgggccggcgactcttcctgaccatgttggggaagcccctggtgttctgtatctgtaggaaggatgccgagagcaggctgggcatgcagatgggagaggagaacctctgggtcatttgcccatgttttcaaagccctgaccccctgcatgtgacctgatacaaaagggaaatctgtccccaagcagagcaatagcaggattatctgggcagtgaacaggaagcccagggcggccacagcccctctgtgtttcctgggtactacctgggccttagttttcttgtagctactatctatccaggcatctccctcctagagggccagagagaggaactggaacttcaaaaaccctacctgatcttactttcaaaatccaaatagacctatgaggatctcttccccaccttgggtgactcccagactggttcatgctctgggggccaaacctgcttccaaaccgggaagaatggtgagatcagtcatgcttcccaggagcctggctacaggaaacccctgtgtttcccaaagggccctcctgaattgcctttccaacactcccagcttactgggactagaggactaaagaccccggcttgggctgctcctaagcagacactgctcttctggggacatctatggctcttggcttgacgacgtgtgtgtgtcttggaggcattttatatatgtttgcctgagccccagccactctggggttgctggggatggctcttgtcaatggacacctccccatcccaacacaacactctgtgtcccagccctgggcctggacttgcacctgtcttggctctgcccagcagcctactgagtgcctgaaacccaaccactcacttctcttccatcacaccaggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgtttccagaattaactaaaatgtccaaccacagcctttggcaaggcctagcatgatctccaacagctgatttttccattcattcatgagcaccagtttgggattaaggacagggcctgagtgatccaggggaaaacccagccctttgtggaacagggtgccttgggtccatccctgaatctgagtcacttgctcttgacttctcgatctttccccacttcactactctgtccccacctgcattggtctctgctgcagccaggccaggatcctggccttcagtgccttcctgacgcccctaccctgtcccctctacaccgccctgacttgttgagaaaccagctttaatttgcacacatttaaatccaggaagaaccaaaccgctgctttccctgctggcttccatctttattcgctgatgaggttttgggaggaggttatattcatcttacgcagggaggaaaaaaaaagaggaaagaggctgtatatttttacatcataattaccagcctcacctgcaactcattctatacaatgacacgaccaagatttgtgtgtttgcccttgtcccatcacagctgcacacaggtgccctgtacacataagtcactgactcagcagcgagttgttccagtcagtcttgcttttagcaaaccgtcatatacatgggcttcccgaggggaccagtccacagggtgaagattcaccaggaagccttggctttgcagagagaaacatctcagctttctttaaagggcatgtggatttgcacataaatttcacccaactcttccaggatacagattattcataaaaccaaggagcttccttcttggccccctgtgggaggacgtgccccttgtgtccccatccccagagccaagctggaaacccaaagtcattgcttagatccattttgtcctggtattccttttactgatcaaagagaaaattttcatcttgccatggacccccccatcctcaccccatccacttgtctccacagctaccttggattgtcagtcaatagaagcccttgactgatattgaccactagacttttgtatccagggaacctagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttgcagctgtgtcagtccaatccctgccctcatcatctctctgtgtgtccctatcttcatatggccatcttcttataaggacacgagtcacattggattaagggcccaccctatttcagtatgacctcatcttaactaattatatctgcaaagaccctctctccaaatgaagtctcattctgaggtactaggaatgaggacttcaacatgtctttttttttttttttttttttttgttggggacaccacaacttataacaccctctaagacattttctcttgtgccttgactggtcctccactgtagaacccaggtgcccttgaagatagattccccagaattcctggtctacaaggtcaggctgttgctgtcatgcttaccaagcttgccccaatcaacacgtcccatcactgaattccaacagctctggatctcagttctgtggctgtatgggaacagcctgtgtgtaagtggcttgtctgtagcggactgtcacttgacccctgaatgtgcctcatgaccctatccaaagcagttggtgacacagcatctgattttatctatactcttgttcattgacaaaggagtggattttgatgagctacattttgctgtttccttttttggctttgcctgtgatgtggggaagttcctaggcagactcatgtggccactctccctggctcccagcctcacctcctcccgtaccacctcaccctcacctgcacacacctgcaagggaatcactttgaactccaaggggagtgacaggcagcaaatgtcagtctgggtcctggaatgtggagccgcagtgaacctctgtcctctctggtcagtgcctgactatgatattaacccaaatcccagactcccttctcgaggccctgcaatccatacccattctgttaccagtttagttttgaaaccagtagtggggcaggaggttgatggaaaatctgcggtcccagtgacctcctggacttgtcttagtagtgcctggcacatagtaagtgctcaagaaatgtttacagaatgcagacagagaggtttgctgggtaagagtaagaccctggcacagggagttagaagggcaccattggcagggctggatggtattgggattcccctttgccagaccatgttgtgggtgccatatcaaccccaatgagtttgtttgttaggtttgttgttgtggtttagagttagagtcttgctctgtcacccaggctggagtacagcgtgatcatagctcactgcagcctcgaactcctggccacaagcaatcctcccaccttagcctctcaagttgctggtactacaggtgcacaccatcatgcctggctaattttttatttgttgtacagacagggtcttgctatgttgcccgcgctggtcttgaactcctggtctcaagcaatccccctgcttcagcctcccaaagcactgggattacagggctaagccattgtgctgagccagtttgccaggtttaatatctgtgacgtatgaagcgacccattgagtcaggtggcccaggatgtctaggaggcagagtaacaatccaccctgaacagccctcattcacagagcacttactacgtgccaggctggaattcctatgatggtttggggagatcagtagtcttattctcgttccaatggggcaactgtggtacagggacagaaaccagcctccaaattgcagacccagcattttaaaaacgagtctttgggctcatccattcccaggaacccacctccaggtcaaggggttcatgtccagctgctcatggggatgttacaatcccagcctctgagacttattggcaacttggaaccaggaaagagagagaggaaaagcaggaagttgtggaagggagggtgcaggggctggcagggaccatactgggagtttgcacggaagcttgaacttatgttctcaaactgacaggctgccagcagcagcccggatttccaggaaatgtacatctgggttggcagagtccctcctgggtccctccagtatccctgctccaggcttcctatcccctccgtctctcctgctggatgttgcactgtggtcccgtgttcctgagaggcgtacatcagtgagtgctcttccctctcaggggtgggaaagggcccttccttcccactcattgggatcatgcagctcccatttcctaacaccaagaatatgaaggattcatctcatggggttgagaatggctgtcctccttccactgaggactgagctggaggagatggactctgtctagaatgtgcctgatctaaataagaccttgtttcccaagcatgtcccatagacctttcattccatggaaaactcgccggatttgcattattgaaagggtcctgggacaagcatgcattggaaatgcttaggtaaaatgaaactaatttcttgattgcaggacttatcagaacttttaagacactattgtgtggttgaatctctaaatgcctgataggaggctgttcttcccaagctttcccaggcttgtttctgaatctccaacaaggtcaacctctgtgaatgagacttgataccttacctggtactgaaggaggcaatgtcaatgtactggcccacagaaaagagctgaccactagcattcatagacactgctaggagatgagaaaggtagcttagagcccgattccatccatgtggacagtggttccatgaacaagaacaccacatctggctgatggtgtcttccaatggaggggtcaaatctgctgtgtgttggtggcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttggaaaatgcagaaagaaagattctgtctctaagactctgtgtatgatcctactcggtaatctgcctgcttggagaaaaatcatttatcttctgggacggcttcaccacaaggcctgaatgctatgcccagtctagtaacagctgggctggaagtcacggcatatgggggccttaaggaataacagtgtgcgtggtggtgtgcaggagagctgcaagggcttttctttcttgaggaggtttgtaaaatttctgctgttcagtctgggcttctgggaagtcagggggtgctgcatataaagggcaggaaaaggagcctgactccaattgctctttggtttcttccctgaatggaaggctcaaaatcaagtttccacccagataagatcttgaggtcctagtggaccaccagctctactcctgagctcttgaaatacctctaatcaccagctcggtggctgagagtaccttcttgtccactgcctcttcttttccttctcgtcttcacttatcccccatccaacttctgcccgataatatctcccctgtattgtaaactgaggagaaagttgcacaattgtagagatgaaaaatagctgccatgtatttagcttaaattagctcagaagaaaggctccctccctccattgagcgggcagcacttgtttatgccaacatgctatttgcatcgcgccttcttaaatttgaaagtctaatgattaaaaacaaatcttagtttttcttttccaccacttaaaaaaaaaaaaccagcttggctagttcttctagtttaaaaataccctgacctccagcactacagtgagaattttggaaaggctggtaccaggatatcaggaggaaataaatacaggccaacaataaccagaggccttttctgagtggtgggcgacaggatgaacaaggtagaagagaggtctttgtgtcctcacacagatgctggcattctgggtttgtctggaattcagtgaacctctgtcctctctgacagagatttcttcaccaaccattcattcagtgggtgatttgttgagcatctactatgtgttagaccctgggcattcagtgatgagtgatacaatgtctcacctgttctgaagcctaaagcccaatggggaagagagacaagaagcaagtcaaccacaaatatataaatttgcaactcatgtagatctatggaaagaaaactcacgggggaccagaaacatgggagagggtatactgtgggagagctgctgacaaaggtctttctgaggaggtgacatttaagtcaagatctaaaggaagagaaggataaagagatgttcattctaagccagggtttctcaacctcagtactgttgagctatttggggccagataattctttgaggtggcgactgtcctgggcattggaggatgttaagcagcttcctcaactctccccacaagataccagtagcacctggtactggtgacatccaaaaacatccccagacacaccctgactttgctgtctggaatcaatcctcataaagccccaagccttggagcacagaggctggaagcccatatggtggcatgtcaggcatggtgtcacctgagcttctctgacccccacttctgatatggcatccagtttggagtctctgttctccatgagctcccatagctgtcccatattccacaaggcattgcttctgggccacggtcctctagttccagcatagccctatttttgggtatgttggtggatttcaaaagcctccagttgacatccaaagtgtgacatccaaaaccatctccagacattgccagatgtcccctgagttgtctccaggccacgcgactaggattcaaatccagcatcctgccatctgcaaccttccatgggagaaaggaaatcagaggagaacaggaaaacacaaggaggggactccttaagtgaacattgcagggaaataggtttttaaagcactagttagcatcaccagtggtttgaaggctgtctaggtaaggagaatgtggacttgcctttcaccgtctgcacggacaggggctgaaatctccagtcattctctccatccttccacagcccttctaagaagcagatcctcttgctgagctgaaatcttgagacttgcatccggcaatcttggtgttgctttctgaggctactcagggaaagcccttctgtattccccaggaaggaaagtctcccagatagtgaagggccttttctaccttccttgcaattcccagttcactgtgaagaagagagtcaggccgggttagaatggctgtctctggtagcaatgaagcaacaacatagacagtctggacaagatgtggcagttctgtccagtcccgtgtgactgatttgggcatggagacaggcagtgggtgaggatggcctctgtaggtccagctgttttacccctagaatcaaatccctggagcttccggcagtcccaggattgggaagggtaacagagaggacgagtcgggcactgcaaaagaccagatcttggaaaattgctttgggaattgggacaccttccaagaagacagttgagttggctggggctctgccctagatggggtcaacctctccccaacacagccctgcccaggttggggcattggcagcttaagtgcgtcctggacaacaaatgtaatgtattggtcctgtaagattctagccattttcctctgcttatttttctacatgtgttacaagtaataatgtttagatgggtacatatgaacttgtgtaagttcaagtaactgctatgtagctacagcatgggcatcaaggtactctaaggtacttgccctgccacaccgaggccccctgccccggccccctttccctcctagccagccttctagggagcactgcacaccctgccccttcaaagctatctggacagtcctggctcgactggagcattaagggaggggctgtccttggtcaggcttctgcccaactgtgtgatgcataaatctttgcctggctccttcttccttcttttcggaagtctatctcctcctgagggcctctgcggtcctaacctatcaaggaatatcatagattgtactccccaccccatcaaaacacaccctgactttgcgtctggaatcaatcctcataaagccccaaggcttggagcacagaggccagaagcccatatggtggcatgtcaggcatgctgtcacatgagcttctctgactccacttccaagatggcatccaatttggagtctctgttctccatgagctcccatagctgtcccatattccacaaggcactgcttctgggccccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgattctggaaaaaatggagaaaagtgggtgctgccttcagggtactaggagtccgatgaagagagggaggagttccagtagggtcccgaggccccacaggagctcccaacccagagaaagaccctccaggaaggattctcagaggaggagacttctgaaccctgtcttgaaatttgagtagaatggtagggaacggtgtgtcagacagaaggaacagcctatgtgtggactcagaggcaagatcatgatttattgagggtaactgcaagtggctaaaatcctgccccctggcacttgcctgcctttccctgctttccccaaagcctgattttgggaccctggagtctccatctccaaacagagggtgccctggctcagatgtggagaccttgacttctttccccagcatgctctggttcctactgttagccttggtgtcctgtgggggaagatgtctgaggagagttttgtgcttgctggagtcagaccagtactcaggccacctcaggcctgctctgcatccctctctggctctacagacctctctctctctctctctctctctctctctctctctctgtctgtctgtctctgtgtctgtctctgtctctgcctgcctccacacagtgaaggatgtgtctctatttcttagtgccctgcattgggtcctgaagtccatgggcatcttggctatagatgggttggccatgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtaggtgcttcatcaatgtggcttttcttctcaatcacccaaatgaacctcccccagaatcccacctctagggggacattcctgaaaaataagggactagaatagcgaggtggtgggtgttacccatttatttagatatttgtgtcctggtgaacatggggagggatgcccaagtgtcataaggacaccccctccccccgtctacaaggcagaggtctcttaggatgtgagagagtctctggcaagaccagcccccaccccaccaaggccctcatagaaacagaacattcttcctccctatcccaaagcagaagttgactggggcagataaggcaagtcacattacatctgtgcccttgaccatacctggaccaggcagagaagatcccagacttaggtggtcaacgtttccaccccaagcctctcatttctcgctctctttgagacttgatcttgtaccaggatccactcgacagacttaacgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaatta

SEQ ID NO: 146630 - DNA, 17008 bp, Homo sapiens
  Payload ID: 9008
  Gene Symbol: KSR2
  Gene Name: kinase suppressor of ras 2
  ENST ID: ENST00000425217
  CDS Start-End: 56-2821
gcagcagcctctgagtttgcaaaaagccttacagcagtgcgaactggtccaaaacatgatagacttgagcatctccaacctggaagggcttaggaccaaatgtgctacctccaacgacctcacacaaaaagaaatccggaccctggagagcaagctggtgaagtacttcagccggcagctgtcctgcaaaaagaaggtagccttgcaggagcgcaacgcggagctggacggcttcccccagctacggcactggttccgaatcgtcgatgtgcgcaaggaggtcctggaggaaatctcccccggccagctgagcctggaggacctcttggagatgacggatgaacaggtgtgcgagactgtggagaaatacggagccaaccgggaggagtgtgcccgcctcaacgcctccctctcctgcctcaggaatgtccacatgtcaggaggcaacctttccaaacaagactggaccatccagtggcccacgacagagacggggaaggagaacaatcccgtgtgccccccggagcccaccccgtggatccgcacccatctctcccagagccccagggtcccgtccaagtgcgtccagcactattgtcacaccagccccactcccggggcccctgtgtacacccacgtggacaggcttaccgtggacgcctacccgggcttgtgcccgcccccgccactggagtcgggccaccgttccctgcccccatcgccccggcagcggcacgcggtccgcaccccgccgcgcacccccaacatcgtcaccaccgtgaccccgccgggcacgccgcccatgaggaagaagaacaagctgaagcccccggggaccccaccgccctcctcccgaaaactgatacacttgatcccgggattcaccgcgctgcatcggagcaaatcccacgagttccagctggggcaccgcgtggacgaggcccacacgcccaaagccaagaagaagagcaaacccttgaacctcaagatccacagcagcgtaggcagctgcgagaacatcccctctcagcagcgctccccgctgctgtccgagcgctccctccgctccttctttgtgggacacgcacctttcctgccttccacccctcctgttcacactgaggccaacttctctgcaaacacactgtcagtgccacgctggtccccgcagatccctcgcagagatctcggcaactccatcaagcacaggttttccaccaagtactggatgtctcagacgtgcacagtctgtgggaaagggatgctttttggcctcaagtgtaaaaactgcaagttaaagtgccacaacaaatgcaccaaagaagccccaccctgtcatcttctgatcatccaccgaggagatccagcaaggttagtccggacagagtccgttccgtgtgacatcaacaaccctctacggaagccacctcgctattcagacctgcacatcagtcagacgctccccaaaaccaacaaaatcaacaaggaccacatccctgtcccttaccagccagactccagcagcaacccctcctccacgacgtcctccacgccctcctcgccagcaccccccctccctcctagtgccacgccgccttctcccctacacccttccccacagtgcacacggcagcagaagaacttcaacctgccagcatcccactactacaaatacaagcagcagttcatcttcccagatgtggtgccggtgccggagacgccgacccgggcgccccaggtcatcctgcatccggtgacctcgaatccaatcttggaaggaaatccattacttcaaattgaagtggagccaacgtcggagaatgaagaggtccatgatgaggccgaagagtcagaggatgacttcgaggagatgaacctgtccctcctctcggcccggagcttcccacgcaaggccagccagaccagcatcttccttcaggagtgggacatcccctttgagcagctggagatcggcgagctcattggaaagggccgctttgggcaagtgtaccacggccgctggcatggcgaggtggccatccggctgattgacattgagagggacaacgaggaccagctcaaggccttcaagcgggaggtgatggcctacaggcagacacggcatgagaacgtggtgcttttcatgggtgcctgcatgagcccgcctcacctggccatcatcaccagcctctgtaagggacggacgctctattccgttgtgagggatgccaaaatcgttttggatgtcaacaaaaccaggcagattgctcaagaaattgtgaagggcatgggctacctccacgccaagggaatcctacacaaggacctcaagtcaaagaacgtcttctatgacaacggcaaagtggtcatcacggactttggactcttcagcatttctggggtgctgcaggctggcaggcgggaggacaaactgcgcatccagaatggctggctatgccacctggcaccagagatcatccgccagctgtcccccgacacagaggaggataagctccccttctccaagcactctgacgtctttgcccttggcacaatctggtatgaactccacgccagggaatggcctttcaagacccaaccagcagaggcaataatctggcaaatgggcacaggcatgaaacccaacctcagccagattggcatgggaaaagaaatctcggacattcttctcttctgctgggcctttgaacaagaagagagacctaccttcaccaagctcatggacatgctggagaaactgccaaagcgaaaccgtcgcctgtctcaccctggacatttctggaagtctgcagagctgtgacctttggacatcgggacggcgcccagctgcctgggctcccgtcacctctccctccctactctgtcctctgccagctcaggaggccagagactcagcatcagagggtaccaaccccgaccgacctgggagcactggacaactgctcggcggcctccctgcacctcagacttgagcccttttcctcgggcagggttggggacccccgagctaggactgaaccggaccagccagggtgatgcgttattgatcagtgcggcccaggggacagcactaatgagagcactgcaggctgcacgtggtgcctttgggctatgggactaggacaggagaccccacgtgggggggctcacagacggggctatgtgtgtgtgtgtctgtgtgtttgacgttgttcactcttgtttccccttgacaagcaagagccagactgtcccaatgacggggcactcctcagttctgtctgtatgtggtaggttccagctgtaccatctgggaagctaagaggagggtacagagccgagtggcagcttagtcaaggctactgagccaagatcgagcagggaaggtcgggagtggctaagctcgttcctttggaaatatctgttttcagacaccccaacccgagcctgtcatggcgtgtggcacctttgcatagagctctgaagtacagtaggaaagttagaacgtcttttgagttctgggtctctctgggggacctattcccccatttctgctgttttctcctgttctctgagagtagcatcccttttcacctcactgcccgcacctccttgccatttggaaagccaagatgacttctgaggggctccttagagctcaccgtcattcagggcaccccctgaagtctggtccctgagaatcagggctctgggcagggagttctaggacattccttttcttccctcttctctgctactcacaccagtgaagcttattcccccaccaaggtggatgcgggttcttggggtacgtccatgttgggttatgtggctgtacctatgataacacgtttgcaaaagatttccctgcctgtcacccttgaggagtcctgttgggggagcacaaagggaggatgtttgttacacttctgcgttctttgctctagcctggtgcggggtcctcaagtagcttccccatcggaagcctgtgtccctcacctgtgtgtgttccctcagtgccccaccttccctccctcctcttgatcccaacctgggccggcgactcttcctgaccatgttggggaagcccctggtgttctgtatctgtaggaaggatgccgagagcaggctgggcatgcagatgggagaggagaacctctgggtcatttgcccatgttttcaaagccctgaccccctgcatgtgacctgatacaaaagggaaatctgtccccaagcagagcaatagcaggattatctgggcagtgaacaggaagcccagggcggccacagcccctctgtgtttcctgggtactacctgggccttagttttcttgtagctactatctatccaggcatctccctcctagagggccagagagaggaactggaacttcaaaaaccctacctgatcttactttcaaaatccaaatagacctatgaggatctcttccccaccttgggtgactcccagactggttcatgctctgggggccaaacctgcttccaaaccgggaagaatggtgagatcagtcatgcttcccaggagcctggctacaggaaacccctgtgtttcccaaagggccctcctgaattgcctttccaacactcccagcttactgggactagaggactaaagaccccggcttgggctgctcctaagcagacactgctcttctggggacatctatggctcttggcttgacgacgtgtgtgtgtcttggaggcattttatatatgtttgcctgagccccagccactctggggttgctggggatggctcttgtcaatggacacctccccatcccaacacaacactctgtgtcccagccctgggcctggacttgcacctgtcttggctctgcccagcagcctactgagtgcctgaaacccaaccactcacttctcttccatcacaccaggacttcttgggtccacaggctccagtccttgtcatgttcccttgtgccaagagacaggatatgaggaagggaagaggcagccagggtctactaccctgcagctgaaatgtccacaagaactggcaccttctcactcttgcctctcttgtttccagaattaactaaaatgtccaaccacagcctttggcaaggcctagcatgatctccaacagctgatttttccattcattcatgagcaccagtttgggattaaggacagggcctgagtgatccaggggaaaacccagccctttgtggaacagggtgccttgggtccatccctgaatctgagtcacttgctcttgacttctcgatctttccccacttcactactctgtccccacctgcattggtctctgctgcagccaggccaggatcctggccttcagtgccttcctgacgcccctaccctgtcccctctacaccgccctgacttgttgagaaaccagctttaatttgcacacatttaaatccaggaagaaccaaaccgctgctttccctgctggcttccatctttattcgctgatgaggttttgggaggaggttatattcatcttacgcagggaggaaaaaaaaagaggaaagaggctgtatatttttacatcataattaccagcctcacctgcaactcattctatacaatgacacgaccaagatttgtgtgtttgcccttgtcccatcacagctgcacacaggtgccctgtacacataagtcactgactcagcagcgagttgttccagtcagtcttgcttttagcaaaccgtcatatacatgggcttcccgaggggaccagtccacagggtgaagattcaccaggaagccttggctttgcagagagaaacatctcagctttctttaaagggcatgtggatttgcacataaatttcacccaactcttccaggatacagattattcataaaaccaaggagcttccttcttggccccctgtgggaggacgtgccccttgtgtccccatccccagagccaagctggaaacccaaagtcattgcttagatccattttgtcctggtattccttttactgatcaaagagaaaattttcatcttgccatggacccccccatcctcaccccatccacttgtctccacagctaccttggattgtcagtcaatagaagcccttgactgatattgaccactagacttttgtatccagggaacctagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctaggactgctgcagcaaaccaccacccactggggcctacaacaacagatgtatcatctctcacccatctggatgccagaagtccaaaatcaaagtgttagcagggccatgttccccctgaaatctgtaagggaatccttcctggcggcttctgaattcctggtgctttcctggtcatcattggcattccttggcttgcagctgtgtcagtccaatccctgccctcatcatctctctgtgtgtccctatcttcatatggccatcttcttataaggacacgagtcacattggattaagggcccaccctatttcagtatgacctcatcttaactaattatatctgcaaagaccctctctccaaatgaagtctcattctgaggtactaggaatgaggacttcaacatgtctttttttttttttttttttttttgttggggacaccacaacttataacaccctctaagacattttctcttgtgccttgactggtcctccactgtagaacccaggtgcccttgaagatagattccccagaattcctggtctacaaggtcaggctgttgctgtcatgcttaccaagcttgccccaatcaacacgtcccatcactgaattccaacagctctggatctcagttctgtggctgtatgggaacagcctgtgtgtaagtggcttgtctgtagcggactgtcacttgacccctgaatgtgcctcatgaccctatccaaagcagttggtgacacagcatctgattttatctatactcttgttcattgacaaaggagtggattttgatgagctacattttgctgtttccttttttggctttgcctgtgatgtggggaagttcctaggcagactcatgtggccactctccctggctcccagcctcacctcctcccgtaccacctcaccctcacctgcacacacctgcaagggaatcactttgaactccaaggggagtgacaggcagcaaatgtcagtctgggtcctggaatgtggagccgcagtgaacctctgtcctctctggtcagtgcctgactatgatattaacccaaatcccagactcccttctcgaggccctgcaatccatacccattctgttaccagtttagttttgaaaccagtagtggggcaggaggttgatggaaaatctgcggtcccagtgacctcctggacttgtcttagtagtgcctggcacatagtaagtgctcaagaaatgtttacagaatgcagacagagaggtttgctgggtaagagtaagaccctggcacagggagttagaagggcaccattggcagggctggatggtattgggattcccctttgccagaccatgttgtgggtgccatatcaaccccaatgagtttgtttgttaggtttgttgttgtggtttagagttagagtcttgctctgtcacccaggctggagtacagcgtgatcatagctcactgcagcctcgaactcctggccacaagcaatcctcccaccttagcctctcaagttgctggtactacaggtgcacaccatcatgcctggctaattttttatttgttgtacagacagggtcttgctatgttgcccgcgctggtcttgaactcctggtctcaagcaatccccctgcttcagcctcccaaagcactgggattacagggctaagccattgtgctgagccagtttgccaggtttaatatctgtgacgtatgaagcgacccattgagtcaggtggcccaggatgtctaggaggcagagtaacaatccaccctgaacagccctcattcacagagcacttactacgtgccaggctggaattcctatgatggtttggggagatcagtagtcttattctcgttccaatggggcaactgtggtacagggacagaaaccagcctccaaattgcagacccagcattttaaaaacgagtctttgggctcatccattcccaggaacccacctccaggtcaaggggttcatgtccagctgctcatggggatgttacaatcccagcctctgagacttattggcaacttggaaccaggaaagagagagaggaaaagcaggaagttgtggaagggagggtgcaggggctggcagggaccatactgggagtttgcacggaagcttgaacttatgttctcaaactgacaggctgccagcagcagcccggatttccaggaaatgtacatctgggttggcagagtccctcctgggtccctccagtatccctgctccaggcttcctatcccctccgtctctcctgctggatgttgcactgtggtcccgtgttcctgagaggcgtacatcagtgagtgctcttccctctcaggggtgggaaagggcccttccttcccactcattgggatcatgcagctcccatttcctaacaccaagaatatgaaggattcatctcatggggttgagaatggctgtcctccttccactgaggactgagctggaggagatggactctgtctagaatgtgcctgatctaaataagaccttgtttcccaagcatgtcccatagacctttcattccatggaaaactcgccggatttgcattattgaaagggtcctgggacaagcatgcattggaaatgcttaggtaaaatgaaactaatttcttgattgcaggacttatcagaacttttaagacactattgtgtggttgaatctctaaatgcctgataggaggctgttcttcccaagctttcccaggcttgtttctgaatctccaacaaggtcaacctctgtgaatgagacttgataccttacctggtactgaaggaggcaatgtcaatgtactggcccacagaaaagagctgaccactagcattcatagacactgctaggagatgagaaaggtagcttagagcccgattccatccatgtggacagtggttccatgaacaagaacaccacatctggctgatggtgtcttccaatggaggggtcaaatctgctgtgtgttggtggcttctccaacataccatggcttggaggccaatgtgaaaagtatataagatgtaacaccctcagaagggttaagttttcacctgagttttcatcttcaaccaagtcattgggatggtgatctagaaggacctctaagatctagaaggataaagatctggtccaaggagtacaaatatgtaatggatctaccaccagtgtcccctgctgtactcttggcagacatcactaatccatcacagcatgccttcccactgatcacagatgtagcttcagggcattcgagttaccacttaagatggatatgagtgaccctcccttatctcactcttctcctttcacagaagcaggatctgaggcccagagagggaagctataataaactcccctaagtcaggtcccttctaagaggcagaggtaggtttagaactcaggcctcagaaacttccagaagccaagccatttgggctgtagttggtggacagtctatcagcgctctgcagatgtttcttctcagttagggaacttggaaaatgcagaaagaaagattctgtctctaagactctgtgtatgatcctactcggtaatctgcctgcttggagaaaaatcatttatcttctgggacggcttcaccacaaggcctgaatgctatgcccagtctagtaacagctgggctggaagtcacggcatatgggggccttaaggaataacagtgtgcgtggtggtgtgcaggagagctgcaagggcttttctttcttgaggaggtttgtaaaatttctgctgttcagtctgggcttctgggaagtcagggggtgctgcatataaagggcaggaaaaggagcctgactccaattgctctttggtttcttccctgaatggaaggctcaaaatcaagtttccacccagataagatcttgaggtcctagtggaccaccagctctactcctgagctcttgaaatacctctaatcaccagctcggtggctgagagtaccttcttgtccactgcctcttcttttccttctcgtcttcacttatcccccatccaacttctgcccgataatatctcccctgtattgtaaactgaggagaaagttgcacaattgtagagatgaaaaatagctgccatgtatttagcttaaattagctcagaagaaaggctccctccctccattgagcgggcagcacttgtttatgccaacatgctatttgcatcgcgccttcttaaatttgaaagtctaatgattaaaaacaaatcttagtttttcttttccaccacttaaaaaaaaaaaaccagcttggctagttcttctagtttaaaaataccctgacctccagcactacagtgagaattttggaaaggctggtaccaggatatcaggaggaaataaatacaggccaacaataaccagaggccttttctgagtggtgggcgacaggatgaacaaggtagaagagaggtctttgtgtcctcacacagatgctggcattctgggtttgtctggaattcagtgaacctctgtcctctctgacagagatttcttcaccaaccattcattcagtgggtgatttgttgagcatctactatgtgttagaccctgggcattcagtgatgagtgatacaatgtctcacctgttctgaagcctaaagcccaatggggaagagagacaagaagcaagtcaaccacaaatatataaatttgcaactcatgtagatctatggaaagaaaactcacgggggaccagaaacatgggagagggtatactgtgggagagctgctgacaaaggtctttctgaggaggtgacatttaagtcaagatctaaaggaagagaaggataaagagatgttcattctaagccagggtttctcaacctcagtactgttgagctatttggggccagataattctttgaggtggcgactgtcctgggcattggaggatgttaagcagcttcctcaactctccccacaagataccagtagcacctggtactggtgacatccaaaaacatccccagacacaccctgactttgctgtctggaatcaatcctcataaagccccaagccttggagcacagaggctggaagcccatatggtggcatgtcaggcatggtgtcacctgagcttctctgacccccacttctgatatggcatccagtttggagtctctgttctccatgagctcccatagctgtcccatattccacaaggcattgcttctgggccacggtcctctagttccagcatagccctatttttgggtatgttggtggatttcaaaagcctccagttgacatccaaagtgtgacatccaaaaccatctccagacattgccagatgtcccctgagttgtctccaggccacgcgactaggattcaaatccagcatcctgccatctgcaaccttccatgggagaaaggaaatcagaggagaacaggaaaacacaaggaggggactccttaagtgaacattgcagggaaataggtttttaaagcactagttagcatcaccagtggtttgaaggctgtctaggtaaggagaatgtggacttgcctttcaccgtctgcacggacaggggctgaaatctccagtcattctctccatccttccacagcccttctaagaagcagatcctcttgctgagctgaaatcttgagacttgcatccggcaatcttggtgttgctttctgaggctactcagggaaagcccttctgtattccccaggaaggaaagtctcccagatagtgaagggccttttctaccttccttgcaattcccagttcactgtgaagaagagagtcaggccgggttagaatggctgtctctggtagcaatgaagcaacaacatagacagtctggacaagatgtggcagttctgtccagtcccgtgtgactgatttgggcatggagacaggcagtgggtgaggatggcctctgtaggtccagctgttttacccctagaatcaaatccctggagcttccggcagtcccaggattgggaagggtaacagagaggacgagtcgggcactgcaaaagaccagatcttggaaaattgctttgggaattgggacaccttccaagaagacagttgagttggctggggctctgccctagatggggtcaacctctccccaacacagccctgcccaggttggggcattggcagcttaagtgcgtcctggacaacaaatgtaatgtattggtcctgtaagattctagccattttcctctgcttatttttctacatgtgttacaagtaataatgtttagatgggtacatatgaacttgtgtaagttcaagtaactgctatgtagctacagcatgggcatcaaggtactctaaggtacttgccctgccacaccgaggccccctgccccggccccctttccctcctagccagccttctagggagcactgcacaccctgccccttcaaagctatctggacagtcctggctcgactggagcattaagggaggggctgtccttggtcaggcttctgcccaactgtgtgatgcataaatctttgcctggctccttcttccttcttttcggaagtctatctcctcctgagggcctctgcggtcctaacctatcaaggaatatcatagattgtactccccaccccatcaaaacacaccctgactttgcgtctggaatcaatcctcataaagccccaaggcttggagcacagaggccagaagcccatatggtggcatgtcaggcatgctgtcacatgagcttctctgactccacttccaagatggcatccaatttggagtctctgttctccatgagctcccatagctgtcccatattccacaaggcactgcttctgggccccggtcctctagtttcctcatagccctatttttgggtacattggtggatttcaaatgcctacagttgagcagccgaaggattctaagaaaattttgcttgtatttcaaaggctcatgtccccagccccattcactacaccctcagcagagcccagcgtggagcaaccttgtcccttcattccccaaatcttcattttatatagtcatttagtaaatatttgttaagtgcctcctgtgattctggaaaaaatggagaaaagtgggtgctgccttcagggtactaggagtccgatgaagagagggaggagttccagtagggtcccgaggccccacaggagctcccaacccagagaaagaccctccaggaaggattctcagaggaggagacttctgaaccctgtcttgaaatttgagtagaatggtagggaacggtgtgtcagacagaaggaacagcctatgtgtggactcagaggcaagatcatgatttattgagggtaactgcaagtggctaaaatcctgccccctggcacttgcctgcctttccctgctttccccaaagcctgattttgggaccctggagtctccatctccaaacagagggtgccctggctcagatgtggagaccttgacttctttccccagcatgctctggttcctactgttagccttggtgtcctgtgggggaagatgtctgaggagagttttgtgcttgctggagtcagaccagtactcaggccacctcaggcctgctctgcatccctctctggctctacagacctctctctctctctctctctctctctctctctctctctgtctgtctgtctctgtgtctgtctctgtctctgcctgcctccacacagtgaaggatgtgtctctatttcttagtgccctgcattgggtcctgaagtccatgggcatcttggctatagatgggttggccatgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtaggtgcttcatcaatgtggcttttcttctcaatcacccaaatgaacctcccccagaatcccacctctagggggacattcctgaaaaataagggactagaatagcgaggtggtgggtgttacccatttatttagatatttgtgtcctggtgaacatggggagggatgcccaagtgtcataaggacaccccctccccccgtctacaaggcagaggtctcttaggatgtgagagagtctctggcaagaccagcccccaccccaccaaggccctcatagaaacagaacattcttcctccctatcccaaagcagaagttgactggggcagataaggcaagtcacattacatctgtgcccttgaccatacctggaccaggcagagaagatcccagacttaggtggtcaacgtttccaccccaagcctctcatttctcgctctctttgagacttgatcttgtaccaggatccactcgacagacttaacgcatgattaatttgattgattactcttgaagttactgaccttaggaaaattcctcaattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaattactgcattgcactactgccaagacaggtctgaattctattgtt

SEQ ID NO: 146631 - DNA, 4134 bp, Homo sapiens
  Payload ID: 9009
  Gene Symbol: KTN1
  Gene Name: kinectin 1 (kinesin receptor)
  Uniprot ID: Q86UP2
  ENST ID: ENST00000395308
  CDS Start-End: 186-4106
tcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgc

SEQ ID NO: 146632 - DNA, 4021 bp, Homo sapiens
  Payload ID: 9009
  Gene Symbol: KTN1
  Gene Name: kinectin 1 (kinesin receptor)
  Uniprot ID: Q86UP2
  ENST ID: ENST00000395309
  CDS Start-End: 73-3993
ggttctttttttttttttgtccccaccttcttccctatttaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgc

SEQ ID NO: 146633 - DNA, 4516 bp, Homo sapiens
  Payload ID: 9009
  Gene Symbol: KTN1
  Gene Name: kinectin 1 (kinesin receptor)
  Uniprot ID: Q86UP2
  ENST ID: ENST00000395311
  CDS Start-End: 120-4040
gtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 146634 - DNA, 4618 bp, Homo sapiens
  Payload ID: 9009
  Gene Symbol: KTN1
  Gene Name: kinectin 1 (kinesin receptor)
  Uniprot ID: Q86UP2
  ENST ID: ENST00000395314
  CDS Start-End: 69-4142
cgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 146635 - DNA, 4449 bp, Homo sapiens
  Payload ID: 9009
  Gene Symbol: KTN1
  Gene Name: kinectin 1 (kinesin receptor)
  Uniprot ID: Q86UP2
  ENST ID: ENST00000438792
  CDS Start-End: 71-3973
gccgccgcgtcttcccggtctcctttcccggccgcacagggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 146636 - DNA, 4473 bp, Homo sapiens
  Payload ID: 9009
  Gene Symbol: KTN1
  Gene Name: kinectin 1 (kinesin receptor)
  Uniprot ID: Q86UP2
  ENST ID: ENST00000413890
  CDS Start-End: 73-3993
ggttctttttttttttttgtccccaccttcttccctatttaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaacttg

SEQ ID NO: 146637 - DNA, 4793 bp, Homo sapiens
  Payload ID: 9009
  Gene Symbol: KTN1
  Gene Name: kinectin 1 (kinesin receptor)
  Uniprot ID: Q86UP2
  ENST ID: ENST00000459737
  CDS Start-End: 188-4261
cgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatccgactctgagagtgtacctcgagactttaaattatcagatgctttggcagtagaagatgatcaagttgcacctgttccattgaatgtcgttgaaacttcaagtagtgttagggaaagaaaaaagaaggaaaagaaacaaaagcctgtgcttgaagagcaggtcatcaaagaaagtgacgcatcaaagattcctggcaaaaaagtagaacctgtcccagttactaaacagcccacccctccctctgaagcagctgcctcgaagaagaaaccagggcagaagaagtctaaaaatggaagcgatgaccaggataaaaaggtggaaactctcatggtaccatcaaaaaggcaagaagcattgcccctccaccaagagactaaacaagaaagtggatcagggaagaagaaagcttcatcaaagaaacaaaagacagaaaatgtcttcgtagatgaaccccttattcatgcaactacttatattcctttgatggataatgctgactcaagtcctgtggtagataagagagaggttattgatttgcttaaacctgaccaagtagaagggatccagaaatctgggactaaaaaactgaagaccgaaactgacaaagaaaatgctgaagtgaagtttaaagattttcttctgtccttgaagactatgatgttttctgaagatgaggctctttgtgttgtagacttgctaaaggagaagtctggtgtaatacaagatgctttaaagaagtcaagtaagggagaattgactacgcttatacatcagcttcaagaaaaggacaagttactcgctgctgtgaaggaagatgctgctgctacaaaggatcggtgtaagcagttaacccaggaaatgatgacagagaaagaaagaagcaatgtggttataacaaggatgaaagatcgaattggaacattagaaaaggaacataatgtatttcaaaacaaaatacatgtcagttatcaagagactcaacagatgcagatgaagtttcagcaagttcgtgagcagatggaggcagagatagctcacttgaagcaggaaaatggtatactgagagatgcagtcagcaacactacaaatcaactggaaagcaagcagtctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaagagtctctacaaatgcaggttcaggatattttggagcagaatgaggctttgaaagctcaaattcagcagttccattcccagatagcagcccagacctccgcttcagttctagcagaagaattacataaagtgattgcagaaaaggataagcagataaaacagactgaagattctttagcaagtgaacgtgatcgtttaacaagtaaagaagaggaacttaaggatatacagaatatgaatttcttattaaaagctgaagtgcagaaattacaggccctggcaaatgagcaggctgctgctgcacatgaattggagaagatgcaacaaagtgtttatgttaaagatgataaaataagattgctggaagagcaactacaacatgaaatttcaaacaaaatggaagaatttaagattctaaatgaccaaaacaaagcattaaaatcagaagttcagaagctacagactcttgtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagctgaaagatctgttgactgaattgcagaaaaaacttgatgattcatattctgaagcagtaagacagaatgaagagctaaatttgttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattcaaa

SEQ ID NO: 146638 - DNA, 255 bp, Homo sapiens
  Payload ID: 9009
  Gene Symbol: KTN1
  Gene Name: kinectin 1 (kinesin receptor)
  ENST ID: ENST00000553710
  CDS Start-End: 1-49
gaaagagcactaccaggtgttaggagcgttttgtctcactttagagtgatcatcctctggcctaccttgacacatgctctccttcaaaatgctaattcagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatt

SEQ ID NO: 146639 - DNA, 291 bp, Homo sapiens
  Payload ID: 9009
  Gene Symbol: KTN1
  Gene Name: kinectin 1 (kinesin receptor)
  ENST ID: ENST00000557267
  CDS Start-End: 110-291
agggactctgcctctaaggatgatgtctgccttggcctgccatgcctggaattccaattcatctttactggttctaaaggttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaa

SEQ ID NO: 146640 - DNA, 1712 bp, Homo sapiens
  Payload ID: 9009
  Gene Symbol: KTN1
  Gene Name: kinectin 1 (kinesin receptor)
  ENST ID: ENST00000555573
  CDS Start-End: 235-1239
gatgagatttctctttagcacaagcctgagcataccatattaggcataaaaacttatattagaaatcatttctgaaattcataggatgggctttgtatggtcaacagtaggtagactctttaatgtacttttcaaggtgctatctcttgatatttttattttgtaatagcaaatgttgataggtagggatctaagttgtattactgtttacctaaaatcttgctacatgtattcatgttctggtttagaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaaggaaaaaaaaaagccaactctgtagacaccttcagagtttagttttataataaaaactgtttgaataattagacctttacattcctgaagataaacatgtaatcttttatcttattttgctcaataaaattgttcagaagatcaaagtggtaaagacaatgtaaaatttaacattttaatactgatgttgtacactgttttacttaacattttgggaagtaactgcctctgacttcaactcaagaaaacacttttttgttgctaatgtaatcggtttttgtaatggcgtcagcaaataaaaggatgcttattattc

SEQ ID NO: 146641 - DNA, 564 bp, Homo sapiens
  Payload ID: 9009
  Gene Symbol: KTN1
  Gene Name: kinectin 1 (kinesin receptor)
  ENST ID: ENST00000554294
  CDS Start-End: 1-416
tgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagacacgatggttggtgatgcagcagccatcttgtgaccaagaagaaaggccaaaagaattgcaggagaattggccctaaaatcaatgaaactctcacccacccctttaacctcttgtctccagacttctgggtatgtaaaaacacaacacaacaaaacaaacaaacagaacaacaacaacaaca

SEQ ID NO: 146642 - DNA, 595 bp, Homo sapiens
  Payload ID: 9009
  Gene Symbol: KTN1
  Gene Name: kinectin 1 (kinesin receptor)
  ENST ID: ENST00000555498
  CDS Start-End: 371-595
gcggcggcggcggcggcggcggcggcgcctcggagcgggcggcccgggctgtagtgccggcgccgccgcgtcttcccggtctcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacagttcttttaagatagggcaggaatgaaaactctcaatatagagcaggattttaaacctggggcccgtgcatattcttcagggaatccagaaacctggagattatatgtaaaacttagttttataggatcacattgacaaaagtaccatggagttttatgagtcagcatattttattgttcttattccttcaatagttattacagtaattttcctcttcttctggcttttcatgaaagaaacattatatgatgaagttcttgcaaaacagaaaagagaacaaaagcttattcctaccaaaacagataaaaagaaagcagaaaagaaaaagaataaaaagaaagaaatccagaatggaaacctccatgaatcc

SEQ ID NO: 146643 - DNA, 2057 bp, Homo sapiens
  Payload ID: 9009
  Gene Symbol: KTN1
  Gene Name: kinectin 1 (kinesin receptor)
  ENST ID: ENST00000554507
  CDS Start-End: 113-1900
aagtgacagttgagagattgaacagtttagttatgtaaaaatttcagtccttttaccccatggatttttattctggaggaaaagattgagcgtataaaagcagaaaccaataatggtgccaagttgttgtttcttcaggtgtaggaagcagaaagacaacaggtaccaacctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattgaaaatctgagaagagaacgagaacatttggaaatggaactagaaaaggcagagatggaacgatctacctatgttacagaagtcagagagttgaaggcacagttaaatgaaacactcacaaaacttagaactgaacaaaatgaaagacagaaggtagctggtgatttgcataaggctcaacagtcactggagcttatccagtcaaaaatagtaaaagctgctggagacactactgttattgaaaatagtgatgtttccccagaaacggagtcttctgagaaggagacaatgtctgtaagtctaaatcagactgtaacacagttacagcagttgcttcaggcggtaaaccaacagctcacaaaggagaaagagcactaccaggtgttagagtgaagtaattgggaaactgttcatttgaggataaaaaaggcattgtattatattttgccaaattaaagccttatttatgttttcaccctttctactttgtcagaaacactgaacagagttttgtcttttctaatccttgttagactactgatttaaagaa

SEQ ID NO: 146644 - DNA, 521 bp, Homo sapiens
  Payload ID: 9009
  Gene Symbol: KTN1
  Gene Name: kinectin 1 (kinesin receptor)
  ENST ID: ENST00000554570
  CDS Start-End: 1-274
tgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcagttgaacaccagaggaagaaaaacaatgagggcatggtaatgcagcagcagcagcagcgctggagacattgaacccgtgtgaaaagagccaggacactggaggccagcagatagcagtgtcagtctttccttctagttttgccacttcgttttctgtgtatacttggctcagtttcctaacttacttgagctgtggtttccctatctatagaatgggaataaatacctcatggggttgttgtaacggtgagaatttgtgaactgccaagtacagtggttggcatatattaagtaataaatggtgattattggcttttta

SEQ ID NO: 146645 - DNA, 588 bp, Homo sapiens
  Payload ID: 9009
  Gene Symbol: KTN1
  Gene Name: kinectin 1 (kinesin receptor)
  ENST ID: ENST00000554890
  CDS Start-End: 102-588
gagagattgaacagtttagttatgtaaaaatttcagtccttttaccccatggatttttattctggaggaaaagattgagcgtataaaagcagaaaccaataatggtgccaagttgttgtttcttcaggtgtaggaagcagaaagacaacaggtaccaacctaataaggatgttgtggaacaaatggaaaaatgcattcaagaaaaagatgagaagttaaagactgtggaagaattacttgaaactggacttattcaggcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagttatctatcacttccaaagttcaggagcttcagaacttattaaaaggaaaagaggaacagatga

SEQ ID NO: 146646 - DNA, 731 bp, Homo sapiens
  Payload ID: 9009
  Gene Symbol: KTN1
  Gene Name: kinectin 1 (kinesin receptor)
  ENST ID: ENST00000553624
  CDS Start-End: 250-731
tatcttcataatatgtttcttaggggatgagatttctctttagcacaagcctgagcataccatattaggcataaaaacttatattagaaatcatttctgaaattcataggatgggctttgtatggtcaacaaatttcagaaagagagaaagaaataagtggtctctggaatgagttagattctttgaaggatgcagttgaacaccagaggaagaaaaacaatgaccttcgggagaaaaactgggaagcaatggaagcattggcatcaactgaaaaaatgctgcaggacaaagtgaacaagacttccaaggaaaggcagcaacaggtggaagctgttgagttggaggctaaagaagttctcaaaaaattatttccaaaggtgtctgtcccttctaatttgagttatggtgaatggttgcatggatttgaaaaaaaggcaaaagaatgtatggctggaacttcagggtcagaggaggttaaggttctagagcacaagttgaaagaagctgatgaaatgcacacattgttacagctagagtgtgaaaaatacaaatccgtccttgcagaaacagaaggaattttacagaagctacagagaagtgttgagcaagaagaaaataaatggaaagttaaggtcgatgaatcacacaagactattaaacagatgcagtcatcatttacatcttcagaacaagagctagagcgattaagaagcgaaaataaggatattga

SEQ ID NO: 146647 - DNA, 730 bp, Homo sapiens
  Payload ID: 9009
  Gene Symbol: KTN1
  Gene Name: kinectin 1 (kinesin receptor)
  ENST ID: ENST00000554567
  CDS Start-End: 688-730
gccgcccgtttcctgccgagcggcgcgacggcacctgagcgactgcggcggcggcggcggcggcggcggcgcctcggagcgggcggcccgggctgtagtgccggcgccgccgcgtcttcccggtctcctttcccggccgcacaggtcaagtaagggagaattgactacgcttatacatcagcttcaagaaaaggacaagttactcgctgctgtgaaggaagatgctgctgctacaaaggatcggtgtaagcagttaacccagtttcagcaagttcgtgagcagatggaggcagagatagctcacttgaagcaggaaaatggtatactgagagatgcagtcagcaacactacaaatcaactggaaagcaatctgcagaactaaataaactacgccaggattatgctaggttggtgaatgagctgactgagaaaacaggaaagctacagcaagaggaagtccaaaagaagaatgctgagcaagcagctactcagttgaaggttcaactacaagaagctgagagaaggtgggaagaagttcagagctacatcaggaagagaacagcggaacatgaggcagcacagcaagatttacagagtaaatttgtggccaaagaaaatgaagtacagagtctgcatagtaagcttacagataccttggtatcaaaacaacagttggagcaaagactaatgcagttaatggaatcagagcagaaaagggtgaacaaagaag

SEQ ID NO: 146648 - DNA, 993 bp, Homo sapiens
  Payload ID: 9009
  Gene Symbol: KTN1
  Gene Name: kinectin 1 (kinesin receptor)
  ENST ID: ENST00000553360
  CDS Start-End: 1-462
gtttctgaacagcctaataaggatgttgtggaacaaatggaaaaatgcattcaagaaaaagatgagaagttaaagactgtggaagaattacttgaaactggacttattcaggtggcaactaaagaagaggagctgaatgcaataagaacagaaaattcatctctgacaaaagaagttcaagacttaaaagctaagcaaaatgatcaggtttcttttgcctctctagttgaagaacttaagaaagtgatccatgagaaagatggaaagatcaagtctgtagaagagcttctggaggcagaacttctcaaagttgctaacaaggagaaaactgttcaggatttgaaacaggaaataaaggctctaaaagaagaaataggaaatgtccagcttgaaaaggctcaacagattgagagttcaggaaagtcttctcctgaggaactgacatctaagccaagaatctgaagggcctgtgagaagagagtggaggataaaagttatctatcacttccaaagttcaggagcttcagaacttattaaaaggaaaagaggaacagatgaataccatgaaggctgttttggaagagaaagagaaagacctagccaatacagggaagtggttacaggatcttcaagaagaaaatgaatctttaaaagcacatgttcaggaagtagcacaacataacttgaaagaggcctcttctgcatcacagtttgaagaacttgagattgtgttgaaagaaaaggaaaatgaattgaagaggttagaagccatgctaaaagagagggagagtgatctttctagcaaaacacagctgttacaggatgtacaagatgaaaacaaattgtttaagtcccaaattgagcagcttaaacaacaaaactaccaacaggcatcttcttttccccctcatgaagaattattaaaagtaatttcagaaagagagaaagaaataagtggtctctggaatgagttagattctttgaaggatgcag

SEQ ID NO: 146649 - DNA, 4860 bp, Homo sapiens
  Payload ID: 9010
  Gene Symbol: KIF11
  Gene Name: kinesin family member 11
  Uniprot ID: P52732
  ENST ID: ENST00000260731
  CDS Start-End: 91-3261
agactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 146650 - DNA, 2003 bp, Homo sapiens
  Payload ID: 9011
  Gene Symbol: KIF12
  Gene Name: kinesin family member 12
  ENST ID: ENST00000374118
  CDS Start-End: 239-1780
ggaagacatcaggatgtaccatctgcccttctgtcggaccccagggtacgtcccatgagcgcggccgagctgcgtcgagggcagcagagcgtgctgcactgctcagggacccggactctgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 146651 - DNA, 2564 bp, Homo sapiens
  Payload ID: 9011
  Gene Symbol: KIF12
  Gene Name: kinesin family member 12
  ENST ID: ENST00000468460
  CDS Start-End: 859-1860
cgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtaagggaatgagaggaatagaaagacagcccatgaggaaacggagcgcttctttccagggagcctggatcaaaggacagaagaggcggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccagcctctcttctgggctctgaggagtcagaaatagaccagacgtggttcctgctctcaggaggcttctagtctcaggagaggacggtagaagaaccatctgctgcacacagaaggcgaccaagaccccacccctttatgccatcctgacattcttggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 146652 - DNA, 5941 bp, Homo sapiens
  Payload ID: 9012
  Gene Symbol: KIF13A
  Gene Name: kinesin family member 13A
  Uniprot ID: Q9H1H9
  ENST ID: ENST00000259711
  CDS Start-End: 107-5524
gcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaca

SEQ ID NO: 146653 - DNA, 4200 bp, Homo sapiens
  Payload ID: 9012
  Gene Symbol: KIF13A
  Gene Name: kinesin family member 13A
  ENST ID: ENST00000358380
  CDS Start-End: 1-2669
aacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggtaaatgcttgacttgtctgtactatgcagaatagagcagagttgtgtcacctgtgaagcagcagtgtgcattaacaagctgagtgctgcatgtggacatgcacggtcatcactccatggttcccgttctcgaattcctctttctcaagcatgcagagtcatggtagaatctcttgtttgttgttgctgctgtggttttatttctttgtgtttatggcttttcaaagtatttttttatgtttcaagtgagaaagatgttttctaggtgttttgaaaagattaaaggccttttttaaaattatttttcttttttgtctttttggggatttctgattttgttttttatagagatagggtcttgctgtgttgcccaggctggtctgaaactcctggcctcaagtgattcttttgccccagcctcccaaggcactgggattgcaggcatgagccgttgtacctggtcaaaaggctgttttttaaataagactaattatgctttttgccacagaatctgtttattcctgtcatatctctccagtagtttaactctggcctgcagaattggctgctgcattactcacatgtaataagagtgttagcattgcttttctaacttgcatgtacttaatatgtattttggccgttgtcgtctttgtgtgtgatgcatctgtgtgtcttaacctttgcagagcatgcctccacctcaggcacataaccctggctgcattgtaccctcaggaagcaatggcagcagcatgccagtagaacacaatagcaaacgtgagaagaagattgtaagttccggaaccatttctgtcatattgcctggtggtgggtttaaggccctttcacagacaatcatccaaatgctagaagaaattaagacatgtattgggtctttgtcttaaagaaaataaaaatgtgaccattggtaatgatattttgcatggatgtggccatgacctacaattttatcttatttatttatttattttttgcttaagtttgcttagaaaaagggagaaaggcacttttattgcttctggcctttataaaaagtgtaacaaagagatctttttaataccaaaatctttctaatgtgcctatacatattgcctagattctgaagttaatctacctagaggaagtgcacttacttggagtaagtaatcatgcatttaatgcatttagctgtggatatgtttggaagcttttttatgttgcctgatgctattgccaagataattctgtagttagagctgcactacaatctatcataatcacccttcatcgtctcactgtctagggtagcctttgttaattagctggcaaaatatattccaataccttggtgccagccttgcattcaggatggcttatatatattttgccacaggtaggctgaaactctacccacaaaacctcattccttagcacttggttttaaaattattaatttgagatacagttttaaaaacactgcataccaggcaccttaggttataaattatacctcaatttacaaaaaaaaaaaaaaaaaaaa

SEQ ID NO: 146654 - DNA, 6924 bp, Homo sapiens
  Payload ID: 9012
  Gene Symbol: KIF13A
  Gene Name: kinesin family member 13A
  Uniprot ID: Q9H1H9
  ENST ID: ENST00000378814
  CDS Start-End: 1-5250
atgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcagattttaaaacactaatcatttgtctttaataaccctgcctttagtttcaaatctaacttaccatatttcta

SEQ ID NO: 146655 - DNA, 5747 bp, Homo sapiens
  Payload ID: 9012
  Gene Symbol: KIF13A
  Gene Name: kinesin family member 13A
  Uniprot ID: Q9H1H9
  ENST ID: ENST00000378826
  CDS Start-End: 20-5332
ccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 146656 - DNA, 5707 bp, Homo sapiens
  Payload ID: 9012
  Gene Symbol: KIF13A
  Gene Name: kinesin family member 13A
  Uniprot ID: Q9H1H9
  ENST ID: ENST00000378843
  CDS Start-End: 19-5292
cgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagattcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaa

SEQ ID NO: 146657 - DNA, 810 bp, Homo sapiens
  Payload ID: 9012
  Gene Symbol: KIF13A
  Gene Name: kinesin family member 13A
  ENST ID: ENST00000506044
  CDS Start-End: 1-810
ctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaa

SEQ ID NO: 146658 - DNA, 1330 bp, Homo sapiens
  Payload ID: 9012
  Gene Symbol: KIF13A
  Gene Name: kinesin family member 13A
  Uniprot ID: Q9H1H9
  ENST ID: ENST00000502704
  CDS Start-End: 161-373
cgggatggcccgcgcgcctcggcgctgcctctcggagctcacggcggagcggcggcggccgcgctcgaggggcgcgcggctgcagcggcggcggcgccgcgcgtgaggggccgcctaaggccgagcgggcgcggcgagcggccgggcgagcgcagccaacatgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggctggtcacagtggctcacatctctaattccagcactttgggaggccaaggcaagaggatcacttgagccgaggatttcaagaccagcctttgcaacatggcaaaaccccatctctacaaaaaatttgtttaaaattagctggacgtggtggcgcatacctgtggtcccagctactcaggagactgaggcaggaggctccagtgagctgtttgagccactgcacgccagcctgggtgacagagccagaccctgtcttcaaaaaaataaaaaattaaagtggcgtgaggtgaattgcatcagaccccacatatgaataaatggatggttggcaaagtgttatatataataagtacaattccttaggtgtccttaggtgtactactaaagtgggtttgtgatagcccatatatttagtcatttatgttcaatagtgttatattcatttgagaaattattttaagaaatttaaaattaagaaagttttaaaagtcctttagtaattagagatttctctgggtgggtggatacggttgtttctaattatcccacacatttaatcatttatgttcaatagtgttgtattttttgagaaattattttaagaaatgcaaaattaagaaagatttaaaagtcctttagtaattagagatttttctagttgggtggataagggttatttctaagtatcttttgagtattttttgtcatatatttcgttttttaggcatgattaaaagtgtatttgaggactcttagacacataaagttgaattcctcagattgagagatagttattgctttttaattttgttaagatgctcagctgttggataaataatgcttttgttaaaatcctgtggggcattcatccaacaaatggggtataagaaaggaatgtgtgtttgtgtacatgttcttctatctgttggtcctaaagagtgtaagaaggtaaatttgaccagtgaaattcataattacagagttttatttggtaatccattaataaatcattttctgaaagca

SEQ ID NO: 146659 - DNA, 4009 bp, Homo sapiens
  Payload ID: 9012
  Gene Symbol: KIF13A
  Gene Name: kinesin family member 13A
  ENST ID: ENST00000502297
  CDS Start-End: 1-2406
gaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttcaccctttaccatgtttgcaggagatgatcgaatacagatgaccctgctgtcgtgtcttcatttgtaaaattctcctacaaatggagacattgaaggattatgtgtatggaaatttttacaaaattcctttctgtacctattctgtagatgcctgtataatcggtctggatgtacagctataaatgtgttgtgagagcaagagagagagaatgggtagagcctgctgtaccttttttcttttaaattcttcgagttggtaaatgagtaagatattggaaaccttaatgaaaagctgctgttcatgatttgtgtgtatagtgagctgactgtagtattttactattgtctgttaaaaaaagaaaaactgtaatttatatcccctttgaactttattgtgtttaattggtacacatttctgtgtgtgtgtgtgtgtatgtgttttagaatacaaactgtgtaattcag

SEQ ID NO: 146660 - DNA, 8745 bp, Homo sapiens
  Payload ID: 9013
  Gene Symbol: KIF13B
  Gene Name: kinesin family member 13B
  Uniprot ID: Q9NQT8
  ENST ID: ENST00000524189
  CDS Start-End: 40-5520
ggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatcacagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtctcctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctcaggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatcttgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccgggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccgtatgtgtctttccatcaaatgaccaacagcttctcaataaaaccagaccatttctcacctgc

SEQ ID NO: 146661 - DNA, 2630 bp, Homo sapiens
  Payload ID: 9013
  Gene Symbol: KIF13B
  Gene Name: kinesin family member 13B
  ENST ID: ENST00000522355
  CDS Start-End: 91-276
gcccccggccccctcccgccgggtcaaccccgaagagtcgccggtggccgcggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaaggtgaggttgccgttccttgaaaaaaacaaagatctcattggataagatcgcctgatatttcctggtgttatttaagcttcagatccctgtctgtgcctgccccaagtccagatcctttgtcctccatgcttttgggtagaattgacttccttttccattctctacctttgagtgtatgtatattttatctgctaggggaatatactctgcatctcacctggccctgacagttcatttcactcaactttcttccttcaaatctgtttaaattctttcttagaagtcttttctgattaatcttccccgaatgtctttttttccttccttatgctaccactctacaaccccttctccacaagttaggtgttcattttgcttatgttattttctacttggaatagcttgctctgtaaaactgctcattagttgtgtcatggtgtcatgtatatattcaggatcatactttttttggtataataaatttaataaaatgtagggggaaagtcccatcacaatcttc

SEQ ID NO: 146662 - DNA, 1267 bp, Homo sapiens
  Payload ID: 9013
  Gene Symbol: KIF13B
  Gene Name: kinesin family member 13B
  ENST ID: ENST00000523130
  CDS Start-End: 1-1257
ttgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgcct

SEQ ID NO: 146663 - DNA, 2765 bp, Homo sapiens
  Payload ID: 9013
  Gene Symbol: KIF13B
  Gene Name: kinesin family member 13B
  ENST ID: ENST00000521515
  CDS Start-End: 64-2295
ccccgaagagtcgccggtggccgcggcagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaaggtgaggttgccgttccttgaaaaaaacaaagatctcattggataagatcgcctgatatttcctggtgttatttaagcttcagatccctgtctgtgcctgccccaagtccagatcctttgtcctccatgcttttgggtagaattgacttccttttccattctctacctttgagtgtatgtatattttatctgctaggggaatatactctgcatctcacctggccctgacagttcatttcactcaactttcttccttcaaatctgtttaaattctttcttagaagtcttttctgattaatcttccccgaatgtctttttttccttccttatgctaccactctacaaccccttctccacaagttaggtgttcattttgcttatgttattttctacttggaatagcttgctctgtaaaactgctcattagttgtgtcatggtgtcatgtatatattcaggatcatactttttttggtataataaatttaataaaatgtagggggaaagtcccatcacaa

SEQ ID NO: 146664 - DNA, 1750 bp, Homo sapiens
  Payload ID: 9013
  Gene Symbol: KIF13B
  Gene Name: kinesin family member 13B
  ENST ID: ENST00000523968
  CDS Start-End: 29-190
gccgaacgagttcctcggcggctgcaggatgggggactccaaagtgaaagtggcggtgcggatacgacccatgaaccggcgagatttgactgtaaggagccagctgatacaatatggtcagattccattaagcagtggttttaagaaactctcatggacctctgggcctgaggaagtgaagagagactgacttgcataccaaatgtgtggtggatgtggatgcaaacaaggttattcttaatcctgtaaatacgaatctttccaaaggagatgcccggggccagccgaaggtgtttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaagtctgggacatctggagagaaagtgggcaaactcagcctggtggatttagctggcagtgaacgagcaacgaagacaggcgctgcaggggacaggctgaaggaagggagcaacattaacaagtccctcacaaccctcggtctggttatctcagctcttgcagatcagagtgctggcaaaaacaagaataaatttgttccatatcgtgactcagttctcacttggctgctcaaagacagcctcgggggtaacagcaagaccgccatggtggctactgtgagtcctgcagctgataactatgatgaaaccctctcaactctgcggtatgcagatcgagccaagcacattgtaaaccacgctgtggtgaatgaggaccctaatgcccgaattatccgggatctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcag

SEQ ID NO: 146665 - DNA, 7274 bp, Homo sapiens
  Payload ID: 9014
  Gene Symbol: KIF14
  Gene Name: kinesin family member 14
  Uniprot ID: Q15058
  ENST ID: ENST00000367350
  CDS Start-End: 440-5386
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggaaacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaa

SEQ ID NO: 146666 - DNA, 6838 bp, Homo sapiens
  Payload ID: 9014
  Gene Symbol: KIF14
  Gene Name: kinesin family member 14
  Uniprot ID: Q15058
  ENST ID: ENST00000614960
  CDS Start-End: 1-4947
atgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggaaacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaattg

SEQ ID NO: 146667 - DNA, 4842 bp, Homo sapiens
  Payload ID: 9015
  Gene Symbol: KIF15
  Gene Name: kinesin family member 15
  Uniprot ID: Q9NS87
  ENST ID: ENST00000326047
  CDS Start-End: 150-4316
gcggcctccatgcgggcgtcaacgtccgatccaagcgccaaattcaaatttgcggccatcttgagcgggcggaattcagtcgcgcgcggtgcagtcgggaggtggaggcaccggctgcattgttttcgggatcgaggggtgagggcgctatggcacccggctgcaaaactgagttacgcagcgtgacaaatggtcagtctaaccaaccaagtaatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtattcgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaa

SEQ ID NO: 146668 - DNA, 3460 bp, Homo sapiens
  Payload ID: 9015
  Gene Symbol: KIF15
  Gene Name: kinesin family member 15
  ENST ID: ENST00000425755
  CDS Start-End: 103-3174
agtaccttgtaatgaggctggccataagaatcagaagcaactggaaatggctgcttaacacacaaaagaacaaaaccaagagccttctactagtcactctcaatggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggttta

SEQ ID NO: 146669 - DNA, 691 bp, Homo sapiens
  Payload ID: 9015
  Gene Symbol: KIF15
  Gene Name: kinesin family member 15
  ENST ID: ENST00000422209
  CDS Start-End: 1-584
aggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaaatgccactgccgccaggagccctgtaacatcagccatcgtcaacccca

SEQ ID NO: 146670 - DNA, 2441 bp, Homo sapiens
  Payload ID: 9015
  Gene Symbol: KIF15
  Gene Name: kinesin family member 15
  ENST ID: ENST00000453693
  CDS Start-End: 1-386
cttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaagccctggtatacagtggtgaacgtagagcttacatccagttgagagacaagcaattgacatttactcatttattcaaacatttattgatatccaacaagccaggcactgatctggtgaattccagaacatttagagttgaaacagtgaacaaaacatccctgtcctcgtggattttaacttctagcacagggagacagagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataat

SEQ ID NO: 146671 - DNA, 4795 bp, Homo sapiens
  Payload ID: 9015
  Gene Symbol: KIF15
  Gene Name: kinesin family member 15
  ENST ID: ENST00000438321
  CDS Start-End: 146-397
cctccatgcgggcgtcaacgtccgatccaagcgccaaattcaaatttgcggccatcttgagcgggcggaattcagtcgcgcgcggtgcagtcgggaggtggaggcaccggctgcattgttttcgggatcgaggggtgagggcgctatggcacccggctgcaaaataatgaaggtgatgccatcaaagtttttgtgcgaattcgtcctcctgcagaaagatctgggtcagctgatggagagcagaacttatgcttatctgtgctgtcctccacgagtctccggctgcactccaaccctgagcccaagaccttcacgtttgatcatgttgcagatgtggataccactcaggaatctgtattcgcaactgtggctaaaagcattgtggagtcttgcatgagcggttataatggtaccatctttgcatatggacagactggctcagggaagacatttactatgatgggaccatctgaatctgataatttttctcataacctgagaggagtaatcccacgaagttttgaatatttgttttccttaattgatcgtgaaaaagaaaaggctggagctggaaagagtttcctttgtaagtgttcctttattgaaatctacaacgagcagatatatgatctactggactctgcatcggctggactgtacttaagggagcatatcaagaagggagtctttgttgttggtgcggtggagcaggtggtaacctcagctgctgaagcctatcaggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtcaggagaaacagaaagagacggccaagtgtgagcagcagatggcaaaagtacagaaactagaagagagcttgcttgctactgaaaaagtgatcagttccctggaaaagtctagagattctgataagaaagttgtagctgacctcatgaaccagatccaggagctaagaacatcggtctgtgagaaaacagaaactatagacaccctgaaacaagaactgaaggacataaattgcaaatacaactctgctttggttgacagagaagagagcagagtgttgatcaagaagcaggaagtggatattctggatctgaaagaaacccttaggctgagaatactttctgaggacatagagagggatatgctctgtgaggacctggctcatgccactgagcagctgaacatgctcacagaggcctcaaaaaaacactcggggctgctgcagtctgcccaggaagaactgaccaagaaggaagccctgattcaggaacttcagcacaagctaaaccaaaagaaagaggaagtagaacagaagaagaatgaatataacttcaaaatgaggcaactagaacatgtgatggattctgctgctgaggatccccagagtcctaagacaccacctcactttcaaacacatttggcaaaactcctggaaacacaagaacaagagatagaagatggaagagcctctaagacttctttggaacaccttgtaacaaagctaaatgaagacagagaagtcaaaaatgctgaaatcctcagaatgaaggagcagttgcgtgaaatggaaaacctacgcctggaaagtcagcagttaatagagaaaaactggctcctgcaaggtcagctggatgatattaaaagacaaaaggaaaacagtgatcagaatcatccagataatcaacagctgaagaatgaacaagaagaaagtatcaaagaaagacttgcaaaaagtaaaatagttgaagaaatgctgaaaatgaaagcagacctagaagaagtccaaagtgccctttacaacaaagagatggaatgccttagaatgactgatgaagtcgaacgaacccaaactttggagtctaaagcattccaggaaaaagaacaactgagatcaaagctggaagaaatgtatgaagaaagagagagaacatcccaggagatggaaatgttaaggaagcaggtggagtgtcttgctgaggaaaatggaaagttggtaggtcaccaaaatttgcatcagaagattcagtacgtagtgcgactaaagaaggaaaatgtcaggcttgctgaggagacagaaaagttgcgtgccgaaaatgtatttttaaaagaaaagaaaagaagtgaatcttgaggattccggtcagctacctaggcatcaccttgtttgaagatgtttcttctcttttacaagtaagacctactcctggccacttaggagagctgaatttatggaccttaattattaaatgtttataaggtggtggtaaccacctcaagtttctgatgaacattctgcatccatatacaccctgtgacagtcagcagtctgctattaagtggcctacttcaaggctttgaatcaacttaagggaaaaccttttgtctttgtaaaaataaaagcctgtagctaaggtttacagtggacattagccagatcattttcttcttagattatgccataatctcctttgattcttatggaagttctaacaatatatggtggttccaacacctgcagtgagtttaatgactgacttagtagcaggtacaagaagcaaacttgttaatatagattatttttgtattcttactttaggtattttcttgagcattttccatgactgtaaataaagccattttttaagataataattaaa

SEQ ID NO: 146672 - DNA, 2240 bp, Homo sapiens
  Payload ID: 9015
  Gene Symbol: KIF15
  Gene Name: kinesin family member 15
  ENST ID: ENST00000481166
  CDS Start-End: 107-2240
cgctatggcacccggctgcaaaatggacagactggctcagggaagacatttactatgatgggtgttgtctggaggatggaggaatagacgtgtggcatcaacatcaatgaacagagaatcgtctaggtctcatgccgtctttacaattacaatagagtcaatggagaaaagtaatgagattgtgaatatacggacctccctactcaacctggtggatttagcaggatctgaaaggcaaaaagatacccatgcagaagggatgagattgaaggaagcaggtaacataaatcgatcattgagctgcctgggccaagtgattacagcacttgtcgacgtgggtaatggaaaacagagacatgtttgctacagagactccaaacttaccttcttactacgggattcccttggaggtaatgccaaaacagccataattgcaaatgttcatcctggatccaggtgttttggggaaaccctatcaacacttaactttgctcaaagagccaagctgattaaaaacaaggcagtagtaaatgaagacacccaaggaaatgtgagccagctccaagctgaagtgaagaggctcaaagaacaactggcggagcttgcttcaggacagacaccaccagaaagcttcctgaccagagacaaaaagaagactaactatatggagtatttccaggaagcaatgttattctttaagaaatctgaacaggaaaagaagtctctgatagaaaaagttacccaattagaagacctcaccctcaaaaaggaaaaatttattcaatctaataaaatgattgtgaaattccgagaggatcaaataatacgcttggaaaagctccacaaggaatcccggggaggttttctgcctgaggagcaggatcgtttgctctcagaattaaggaatgagattcaaactctgcgagaacaaatagagcaccaccccagagttgcaaagtatgctatggaaaatcattccctcagggaggagaatagaagactgagattattagagcctgtgaaaagagctcaagaaatggatgcccagaccattgcaaaactagaaaaagctttctctgaaataagtggcatggagaaaagtgacaaaaatcagcaaggattttcacctaaagctcagaaagagccatgtttgtttgcaaacactgagaagttaaaagcacaactcctgcaaattcagacagagctgaataattcaaagcaagaatatgaagaattcaaagaacttactaggaaaaggcagctagaattggaatcagagcttcagtctttgcaaaaagcgaaccttaatcttgaaaaccttttggaagcaacaaaagcctgcaagcggcaagaagtttctcagctgaataaaattcatgctgaaacacttaagattataactacaccaaccaaggcctaccaacttcattcccgaccagtaccaaaattaagccctgaaatgggaagctttggctctctatacactcagaattctagcatattagataatgatatattaaatgagccagttcctcctgagatgaatgaacaagcttttgaggccatttctgaagagcttagaacagtgcaggaacaaatgagtgctcttcaagccaaactggatgaagaagagcataaaaacctaaagcttcagcagcatgttgacaaactggaacatcattctacccaaatgcaggagcttttctcatcagaaagaattgattggaccaaacagcaggaagagcttctctcacagttgaatgtccttgaaaagcagcttcaagagactcaaactaaaaatgactttttgaaaagtgaggtacatgacctgcgagtagtccttcattctgctgacaaggagctttcttcagtgaaattggaatatagttcattcaaaacgaatcaggagaaagaattcaacaaactttccgaaagacacatgcatgtacagcttcaattagataatctcaggttagaaaacgaaaagctgcttgagagcaaagcctgcctacaggattcctatgacaacttacaagaaataatgaaatttgagattgaccaactttcaagaaacctccaaaacttcaaaaaagaaaatgaaactctgaaatctgatctgaataatttgatggagcttcttgaggcagaaaaagaacgcaataacaaattatcattacagtttgaagaagataaagaaaacagttctaaagaaatcttaaaagttcttgaggctgtacgtc

SEQ ID NO: 146673 - DNA, 2441 bp, Homo sapiens; identical to SEQ ID NO: 146670
  Payload ID: 9015
  Gene Symbol: KIF15
  Gene Name: Kinesin family member 15
  ENST ID: ENST00000629073
  CDS Start-End: 1-386

SEQ ID NO: 146674 - DNA, 4842 bp, Homo sapiens; identical to SEQ ID NO: 146667
  Payload ID: 9015
  Gene Symbol: KIF15
  Gene Name: Kinesin family member 15
  ENST ID: ENST00000627272
  CDS Start-End: 150-4316

SEQ ID NO: 146675 - DNA, 4795 bp, Homo sapiens; identical to SEQ ID NO: 146671
  Payload ID: 9015
  Gene Symbol: KIF15
  Gene Name: Kinesin family member 15
  ENST ID: ENST00000631233
  CDS Start-End: 146-397

SEQ ID NO: 146676 - DNA, 691 bp, Homo sapiens; identical to SEQ ID NO: 146669
  Payload ID: 9015
  Gene Symbol: KIF15
  Gene Name: Kinesin family member 15
  ENST ID: ENST00000627473
  CDS Start-End: 1-584

SEQ ID NO: 146677 - DNA, 2240 bp, Homo sapiens; identical to SEQ ID NO: 146672
  Payload ID: 9015
  Gene Symbol: KIF15
  Gene Name: Kinesin family member 15
  ENST ID: ENST00000625939
  CDS Start-End: 107-2240

SEQ ID NO: 146678 - DNA, 3460 bp, Homo sapiens; identical to SEQ ID NO: 146668
  Payload ID: 9015
  Gene Symbol: KIF15
  Gene Name: Kinesin family member 15
  ENST ID: ENST00000627705
  CDS Start-End: 103-3174

SEQ ID NO: 146679 - DNA, 5261 bp, Homo sapiens
  Payload ID: 9016
  Gene Symbol: KIF16B
  Gene Name: kinesin family member 16B
  Uniprot ID: Q96L93
  ENST ID: ENST00000354981
  CDS Start-End: 159-4112
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatcta

SEQ ID NO: 146680 - DNA, 606 bp, Homo sapiens
  Payload ID: 9016
  Gene Symbol: KIF16B
  Gene Name: kinesin family member 16B
  ENST ID: ENST00000355755
  CDS Start-End: 1-606
aggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtag

SEQ ID NO: 146681 - DNA, 4640 bp, Homo sapiens
  Payload ID: 9016
  Gene Symbol: KIF16B
  Gene Name: kinesin family member 16B
  Uniprot ID: Q96L93
  ENST ID: ENST00000408042
  CDS Start-End: 159-4337
gcaggtggggctgccgcggaactccaggtccggccgggagcagaggggcgggggcgagagggaagtgggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcatggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaaattccagactaccttggttgacatgatttactttcttcatggaaatatggaagtcaatgtcccttccctggcagaagttcagttactgctctacacaacagtgaaagtcatgggtgactctggccatgaccagtgccagtcgctagtccttctgaacacccacattgcactggtgaaggaagactgtgttttttatccacgcattcgatctcgaaacatacctcctccgggtgcacaatttgatgtgatcaaatgccatgctttaagtgaattcaggtgtgttgttgttccagaaaagaaaaatgtgtcaacagtagaactagtcttcttacagaaactcaaaccttcagtgggttccagaaatagtccacctgagcaccttcaggaagccccaaatgtccagttgttcaccaccccattgtatcttcaaggcagtcagaatgtcgcacctgaggtctggaaacttactttcaattctcaagatgaggctctttggctaatctcacatttgacaagactctaaggaggagacttttaaagatgcactacatgttttttgagatcattaataaaataagcattgtgaaaacagtcaaggcaatatgaatatctccgtgtagctaattgaattggaactggaaaaatgcagacctctaaaattgaaaatgtaaatattttaaatatctacaataaaataaaaacagctaatagcagagccccaataaaatatctttatcatcaccttgcttcattttcttgaaactcaggcttgtaaatttgtgcctgcttcattatttgtgaggtgattaaagcatttctgattgtt

SEQ ID NO: 146682 - DNA, 556 bp, Homo sapiens
  Payload ID: 9016
  Gene Symbol: KIF16B
  Gene Name: kinesin family member 16B
  ENST ID: ENST00000450176
  CDS Start-End: 1-556
ccgacctctcgaagtcccgtgagaacctgtctgcagtcatgttgtataaccccggtcttttccctataaaaggacccatctgtctaagacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagact

SEQ ID NO: 146683 - DNA, 3969 bp, Homo sapiens
  Payload ID: 9017
  Gene Symbol: KIF17
  Gene Name: kinesin family member 17
  Uniprot ID: Q9P2E2
  ENST ID: ENST00000247986
  CDS Start-End: 312-3401
gggcggctccgggctcgggttctgcggcggcgcctgcagcgcggatcccccacgtccccgctcgggccgggcctcagaaacgggcgagcccgggcgcgggaggaagcggcggccccggctcgggtcctgcgacgcccagctcccctccggggcgccccccgaggggtccccgccccccgccgcggccccgcccctgcctcaaggccccgccccccgtggccggcgctggccccgccccttggcccgggctgctgggagtccccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagat

SEQ ID NO: 146684 - DNA, 3572 bp, Homo sapiens
  Payload ID: 9017
  Gene Symbol: KIF17
  Gene Name: kinesin family member 17
  ENST ID: ENST00000375044
  CDS Start-End: 213-3002
ctatccgctggtggaggtgagggcgcccggcaggccgccctgcaggcggcagggcatgaggccgccccgagagtccccagggggctgcgctgccccccagccaggaggaaaggccctcgaggggcgcaggcggacgggaacagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataa

SEQ ID NO: 146685 - DNA, 3731 bp, Homo sapiens
  Payload ID: 9017
  Gene Symbol: KIF17
  Gene Name: kinesin family member 17
  Uniprot ID: Q9P2E2
  ENST ID: ENST00000400463
  CDS Start-End: 75-3161
cttggcccgggctgctgggagtccccggcggggcgggggtcagctctggtcccgttggtcctgggcgcggcgccatggcctccgaggcggtgaaggttgtcgtgcgctgccgtcccatgaaccagcgggagcgagagctgcgctgccagcccgtggtgactgtggactgcgcgcgcgcccagtgctgcatccagaacccgggcgccgccgacgagccgcccaagcagttcaccttcgacggcgcctaccacgtggaccacgtcaccgagcagatctacaacgagatcgcctatccgctggtggagggcgtcactgagggctacaatggcaccatctttgcctacggccagacaggcagcgggaagtccttcaccatgcagggcctgccggatccgccctcccagagaggcatcatccccagggccttcgagcacgtgttcgagagcgtccagtgtgcagagaacactaagttcctggtccgggcctcctacctggagatctacaatgaagatgtccgggacctccttggggctgacaccaagcagaagctggagctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagcgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctccgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataa

SEQ ID NO: 146686 - DNA, 3568 bp, Homo sapiens
  Payload ID: 9018
  Gene Symbol: KIF18A
  Gene Name: kinesin family member 18A
  Uniprot ID: Q8NI77
  ENST ID: ENST00000263181
  CDS Start-End: 292-2988
gacgagcaagcaaagagcttcccctgcgcagccaggctgagcttcttggcgccaagctgccgcgagccgtgacagcgtccgacgtgatgacatcacgcgagcggcagccaatgaaacgaagcgctgaggaaagtggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 146687 - DNA, 4217 bp, Homo sapiens
  Payload ID: 9019
  Gene Symbol: KIF18B
  Gene Name: kinesin family member 18B
  ENST ID: ENST00000587309
  CDS Start-End: 25-2526
ccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaagaaggaggaggggacggggagctgagacccagaagaaaggagggcctagggtattgccaagcatctcagggatgctgctgatgagacaggtgggaggtgggctggaggacggggacagagcgtcactttccttcctcgctgcactccccgccacccatccaactggcctgcagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccaggagctggacctgccttccttacctgggagcaattagtgccaacacacctttgctgtattaacatccctccccagacatccatcctgctactcaccctctgttaatctcctgttacactcagcttcttggcatgtacatattcatttgtgagtgttaatgtgctgctgttttttgttttttggtggtttttgttttttgttttttttgttttgagatggagtcttactctgtcgcccaggctggagtgcagtggtacgatcttggctcactgcaacctccgcctcctgggttcaagtaattctcctgcctcagctttccaagtagctgggattacaggcacccatcaccacacccagctaattttcgtctttttaatagagagggggtttttccatgttggccaggctggtcttgaactcctgacctcaggtgatccgcctgcctcagcttcccaaagtgctgagattacaggcatgagctaccacgcctggcccgtgttgctgttttaaaggtgctgccatgttcccccatcttttttttttttgagatggagtctcgctctgtcgcccaggctggagtgcagtggtggcgatcttggctcactgcaagctccgcctcccaggttcacaccattctcctgcctcagcctcccaagtagctgggactacaggcgcccaccaccacgcctggctaattttttgtatttttagtagagatggggtttcaccgtgttagccaggctggtctcgatctgacctcatgatccacccgcctcggcctcccaaagtgctgggattacaggcgtgagccactgcgcccggcctcccctctcatttatgatgccctctgtgcaggcagacggctcttgggctcttttccccacctgtctctaacacaggccccacggtgatggccacaggcagtagaggaggaatgaggatgggttggggagcggggagtcgcggcttggctcttcctggtttctgagagggacatcttcatccctactccccttggtccccaaccacagtcctggtgaagatgtggatgataatggtgccttgatttccaaatgaagacagctttattgcttaactctattgtacataggatacacgttcagtgtaaaataaagtgtaaaggggaattcaggcttaatgctgcacctagatataaatgctaatgatacttgggtttatagccttctgatcctttatttctgcatatatatatagatatatacatatatttttggtataacaataaaccgtctccatccttgg

SEQ ID NO: 146688 - DNA, 2569 bp, Homo sapiens
  Payload ID: 9019
  Gene Symbol: KIF18B
  Gene Name: kinesin family member 18B
  Uniprot ID: Q86Y91
  ENST ID: ENST00000590129
  CDS Start-End: 1-2529
atgtctcacccaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccaggtgactggcactagggacagggatagcctgggccatggaggccgatgaagacaa

SEQ ID NO: 146689 - DNA, 2745 bp, Homo sapiens
  Payload ID: 9019
  Gene Symbol: KIF18B
  Gene Name: kinesin family member 18B
  ENST ID: ENST00000593135
  CDS Start-End: 99-2657
tcccggtgtgggtactgctgtctgtggtgtggctgtgggacccgtgagcaagcagcgacgccagcggcggagaaccgacgaaaggtgtcaccacagtgatggcagtggaggacagcacgctgcaagtagtggtacgggtgcggccccccacccctcgggagctggacagtcagcggcggccagtggttcaggtggtggacgagcgggtgctggtgtttaaccctgaggagcccgatggagggttccctggcctgaaatggggtggcacccatgatggccccaagaagaagggcaaagacctgacgtttgtctttgaccgggtctttggcgaggcggccacccaacaggacgtgttccagcacaccacgcacagcgtcctggacagcttcctccagggctacaactgctcagtgtttgcctacggggccaccggggctgggaagacacacaccatgctgggaagggagggggaccccggcatcatgtacctgaccaccgtggaactgtacaggcgcctggaggcccgccagcaggagaagcacttcgaggtgctcatcagctaccaggaggtgtataatgaacagatccatgacctcctggagcccaaggggccccttgccatccgcgaggaccccgacaagggggtggtggtgcaaggactttctttccaccagccagcctcagccgagcagctgctggagatactgaccagggggaaccgtaaccgcacgcagcaccccactgatgccaacgcgacttcctcccgctcccatgccatcttccagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgctctctgctggcgctcatcaacgtcctcaatgccttggccgatgcaaagggccgcaagacccatgtgccctaccgggacagcaaactgacccgcctgctcaaagactccctcgggggcaactgccgcacagtgatgatcgctgccatcagcccctccagcctgacctacgaggacacgtacaacaccctcaaatatgccgaccgggccaaggagatcaggctctcgctgaagagcaatgtgaccagcctggactgtcacatcagccagtatgctaccatctgccaacagctccaggctgaggtagccgctctgaggaagaagctccaagtgtatgaggggggaggccagcccccaccacaggacctcccaggatctcccaagtcgggaccaccaccagaacaccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggttccaacccagatgccagagcagaaccccacacatgcactgccagagtcccctcgcctgaccctgcagcccaagccagtcgtgggccacttctcagcacgggaactggatggggaccgttctaagcagttggccctaaaggtgctgtgcgttgcccagcggcagtactccctgctccaagcagccaacctcctgacgcccgacatgatcacagagtttgagaccctacagcagctggtgcaagaggaaaaaattgagcctggggcagaggccttgaggacttcaggcctggccaggggggcacctctggctcaggagctgtgttcagagtcaatccctgtgccgtctcctctctgcccagagcctccaggatacactggccctgtgacccggactatggcgaggcgactgagtggccccctgcacaccctgggaatcccgcctggacccaactgcaccccagcccaggggtcccgatggcccatggagaagaagaggaggagaccaagcgccttggaggcagacagtcccatggccccaaagcggggcaccaagcgccagcgccagtccttcctgccctgcctaaggagagggtctctgcctgacacccaaccttcacaggggcccagcacccccaaaggagaaagggcctcctccccctgccattcccctcgcgtttgcccagccacagtcatcaaaagccgggtgcccctgggcccttccgccatgcagaactgctccaccccgctggctctgcccactcgagacctcaatgccacctttgatctctctgaggagcctccctcaaagcccagtttccatgaatgcattggctgggacaaaataccccaggagctgagcaggctggaccagcccttcatccccagggcacctgtgcccctgttcaccatgaagggccccaagccaacatcttccctccctgggacctctgcctgcaagaagaagcgcgttgcgagttcctcagtctcccatggccgcagccgcatcgcccgcctccccagcagcactttgaagaggccagctgggccccttgtactcccagagctgcccttgagtcccctgtgccctagcaaccggaggaatggaaaggacctcatcagggtggggagagcactctcagcagggaacggcgtcaccaaggtgtcctgaccgccagaatgtcctgaccaccaaggtgtcctaacctaccggcccctctgctggatacccctcttggacctgtagccacctgcaccag

SEQ ID NO: 146690 - DNA, 3643 bp, Homo sapiens
  Payload ID: 9020
  Gene Symbol: KIF19
  Gene Name: kinesin family member 19
  Uniprot ID: Q2TAC6
  ENST ID: ENST00000389916
  CDS Start-End: 139-3135
gcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatctacaatgagatgatccgggacctgctgaacccctccctgggctacctggagctgcgggaggactctaagggggtgatccaggtggccggcatcaccgaagtctccaccatcaatgccaaggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcctccagggccctgcaggacagctccttgcccaaaattaccccagcaggaacctcactgaccccagattctgacctggagagtgtgaagacattgagctctgatgcccagcacctgcagaacagcgccctccctcccctcagcacagagagtgaaggccaccacgtgttcaaggctggtactggggcctggcaggcaaaaagctcctctgtgcccaccccacctcccatccagctcggcagcctggtgacgcaggaggccccggctcaggacagcctgggcagctggatcaactcttcccctgacagcagtgagaacctgtcggagatccccttgtcccacaaagagaggaaggagatcctgactggcaccaagtgcatctgggtgaaggccgcccggcggcgctcgcgggccctgggaaccgaggggcgacacctgctggcacccgcgacagagcgcagcagcctgtccctgcactcactgagcgagggcgacgatgcgcggccaccaggcccactggcctgcaagcggccgcccagccccacactacagcatgctgccagtgaggacaacctgtccagcagcacgggcgaggccccgtcccgggcagtcggacatcatggggacggccccaggccctggctgcgtggccagaagaaaagcctgggcaagaaaagggaggagtcgctggaggcaaagagaaggaagcggaggtcccgatccttcgaggtcaccgggcaagggctctcccaccccaagacacacctcctggggccccatcaggcggagcgcatctcggaccacaggatgccagtgtgcaggcacccagcccctggtatccggcatctgggaaaggtcacgctacctttggccaaagtcaaactccctccaagccagaacacgggcccgggggactcctcacccctggctgttccccccaacccaggtggtggttctcgacgggctacccgtgggccccgcctgccccacggcacaagcacccatggcaaagatggatgctcccggcataactgaggggccctgcctggaactggctctctcacctcccaagactgaatggggtctagcagggcatgggaggtggaggctgggcagatggagatgaccaggaagtaagctcaggatctcagcaggccagggctcctgagacccaggaactggggtctctgcccaaccctcccatgctttcagtgccactggggaaaagaggtgaggccaggggacatggccaggacggctgggctccctggcttcccagccctggacagaatgctgttgccaaaacctgcacagccctgaggccagcctcggccttggtaacggaggaaagcagctgacagtgagacggggctcctggcccacgtgtggggcacgggcatcctggatggttggggaggcgccgacaggcacttcacgtattacaattggggatgtgggtgagggagggaatctggttttgttacttggcagtggttttttctcacccttcctttttaacaataaaatcccatttgggtcttga

SEQ ID NO: 146691 - DNA, 1980 bp, Homo sapiens
  Payload ID: 9020
  Gene Symbol: KIF19
  Gene Name: kinesin family member 19
  ENST ID: ENST00000551294
  CDS Start-End: 141-1980
gcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtggcgcttcgggtccggcccatcagcgtggcagagctggaggaaggagctaccctcatcgcccataaagtggatgagcagatggtggttctcatggacccaatggaggatcccgacgacatcctgcgggcgcatcgctcccgggagaagtcctacctgttcgacgtggcctttgacttcaccgccacccaggagatggtgtatcaggccaccaccaagagcctcatcgagggcgtcatctcaggctacaatgccactgtctttgcctatggccccacaggctgtgggaaaacctacaccatgctgggcacagaccaggagcctggcatctatgttcagaccctcaacgacctcttccgtgccatcgaggagaccagcaatgacatggagtatgaggtctccatgtcctacctggagatcatgcagctgctgatgaaggggaaccggcagaggacccaggagcccacggccgccaaccagacgtcctcccgctcccacgcggtactgcaggtgaccgtgcgccagcgcagccgggtcaagaacatcttgcaggaggtgcggcagggccgcctgttcatgatcgacctggctggctcagagcgcgcctcgcagacacagaatcgtgggcagcgtatgaaggagggggcccacatcaaccgctcactgctggcactgggcaactgcatcaacgccctgagcgacaagggtagcaacaagtacatcaactatcgcgacagcaagctcacccggctcctgaaggactctctgggaggaaacagccgcacagtgatgatcgctcacatcagtcctgcgagcagtgccttcgaggagtcccggaacaccctgacctacgccggccgggccaagaacattaagactagggtgaagcagaacctcctgaacgtctcctaccacatcgcccagtacaccagcatcatcgctgacctgcggggcgagatccagcgactcaagcgcaagattgatgagcagactgggcggggccaggcccggggccggcaggatcggggtgacatccgccacatccaagctgaggtccagctgcacagcgggcagggtgagaaggctggcatgggacagcttcgggagcagctcgccagcgccttccaggagcagatggatgtgcggaggcgcctgctggagctggagaaccgcgccatggaggtccagattgacacctcccgacacctgctcaccatcgccggctggaagcatgagaagtcccgccgggccctcaaatggcgggaggagcagcgaaaggagtgctacgctaaggacgacagcgagaaggactcagacacaggtgatgaccaaccagacatcctggagccacccgaggtggccgcagcccgggagagcattgcagccctggtggacgagcagaagcaactgcgcaagcagaagctggcgctggagcagcgctgccgggagctgcgcgcgcggggccggcgcctggaggagacgctgccgcggcgcatcggctccgaggagcagcgcgaggtgctcagcctgctgtgccgcgtgcacgagctcgaggtggagaacaccgagatgcagtcgcacgcgctgctccgcgacggtgcgctccgccaccgccacgaggccgtgcgccgcctggagcagcaccgcagtctctgcgacgagattatccagggccagcggcagatcatcgacgactacaacctggccgtcccgcagcgcctggaagagctctacgaagtgtacctgcgggagctggaggagggcagcctggagcaggccaccatcatggaccaagtggcct

SEQ ID NO: 146692 - DNA, 8832 bp, Homo sapiens
  Payload ID: 9021
  Gene Symbol: KIF1A
  Gene Name: kinesin family member 1A
  Uniprot ID: Q12756
  ENST ID: ENST00000320389
  CDS Start-End: 160-5232
cacagcgcagagcagccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 146693 - DNA, 4414 bp, Homo sapiens
  Payload ID: 9021
  Gene Symbol: KIF1A
  Gene Name: kinesin family member 1A
  ENST ID: ENST00000404283
  CDS Start-End: 1-4414
atggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaattgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccgcgtttcattgggaaatgacactaggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcag

SEQ ID NO: 146694 - DNA, 680 bp, Homo sapiens
  Payload ID: 9021
  Gene Symbol: KIF1A
  Gene Name: kinesin family member 1A
  ENST ID: ENST00000428768
  CDS Start-End: 1-680
ggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaatacgtgtccgaccttgagaacaataaccttaaccgtggcgggacggtgaatg

SEQ ID NO: 146695 - DNA, 585 bp, Homo sapiens
  Payload ID: 9021
  Gene Symbol: KIF1A
  Gene Name: kinesin family member 1A
  ENST ID: ENST00000448728
  CDS Start-End: 471-585
acgtccccgggaatagggactttcccccagagactggaggaccccttccccaagcgtcagccctttccaaggggtgcctgcattgctggaattaaaggcctgccagggcaagcggattggatcttgcggctgcggagaggaggcggtgcggagaggcccctgcctcgcagggctggcactggcctcaccctggggacgcacagcgcgacaccgtgctcggctctgcgggacaccaggtcgcactcaggctggcggggcctttgccagggaagccatgccagcaccctcgtggtgtgagaaggcagcagaggcttcctcaggcttgcgaagctgggttccactggtcccgctgggctcctgctttctagaattatctgcgctgcctcctctccttgtggattccaccccatgtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgtta

SEQ ID NO: 146696 - DNA, 1072 bp, Homo sapiens
  Payload ID: 9021
  Gene Symbol: KIF1A
  Gene Name: kinesin family member 1A
  ENST ID: ENST00000431776
  CDS Start-End: 1-1072
ttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggcagtttcttgattcggacatacctaggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctc

SEQ ID NO: 146697 - DNA, 550 bp, Homo sapiens
  Payload ID: 9021
  Gene Symbol: KIF1A
  Gene Name: kinesin family member 1A
  ENST ID: ENST00000415042
  CDS Start-End: 1-550
agctggggagtgagggtgaacaccagggaagggccccagccctgctgctggaagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagt

SEQ ID NO: 146698 - DNA, 9223 bp, Homo sapiens
  Payload ID: 9021
  Gene Symbol: KIF1A
  Gene Name: kinesin family member 1A
  Uniprot ID: Q12756
  ENST ID: ENST00000498729
  CDS Start-End: 248-5623
ggacgccgcgcgcagccaaccagcgcctcgggaggggcgcggggcggtccgggccgggggcgcgcagcccgtcacgcggcggcgccgtcacagcgcagagcagccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacaccaacactgtgcctggaggacccaaattgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagttcagccatctctggctgcaacagctaccctcttctcaacacatgcatgagcgagcgcatggctgctctcaccccctcccccaccttctcgagccccgactccgacgccaccgagcctgccgaggagcagagcgtgggggaggaggaggaggaggaggaggaggaggaggatgaggaggaggaggacctggaggacgacgtctttccggagcacgcgctgtgcgacggccgggacccgttttacgaccggccccccctgttcagtttagtaggaagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtc

SEQ ID NO: 146699 - DNA, 6816 bp, Homo sapiens
  Payload ID: 9022
  Gene Symbol: KIF1B
  Gene Name: kinesin family member 1B
  Uniprot ID: O60333
  ENST ID: ENST00000263934
  CDS Start-End: 154-5466
cccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcag

SEQ ID NO: 146700 - DNA, 8746 bp, Homo sapiens
  Payload ID: 9022
  Gene Symbol: KIF1B
  Gene Name: kinesin family member 1B
  Uniprot ID: O60333
  ENST ID: ENST00000377081
  CDS Start-End: 80-5551
gaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgca

SEQ ID NO: 146701 - DNA, 5885 bp, Homo sapiens
  Payload ID: 9022
  Gene Symbol: KIF1B
  Gene Name: kinesin family member 1B
  Uniprot ID: O60333
  ENST ID: ENST00000377083
  CDS Start-End: 314-3775
ggattcttttcacacagtagtgttggctttgttctgttgggagggaaactattcctctaaaaaatgttcacatttttcctattacttcattcagtagtgaaatgtaatgatttgactctgccatgagtcagtggcatatctgagggatctttgaagttaaaggaaattggccaggcgcagtgactcacgcttataatcccagcactttgggagaccgaggcaggtgaatctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtcttt

SEQ ID NO: 146702 - DNA, 10669 bp, Homo sapiens
  Payload ID: 9022
  Gene Symbol: KIF1B
  Gene Name: kinesin family member 1B
  Uniprot ID: O60333
  ENST ID: ENST00000377086
  CDS Start-End: 203-5653
ggaggctgcttgagcaagctagtcattgttcatgcaacacaaaacattcccgcccctaacgccagaatggagcttccagatccctttttttttttttccttgattgctaaatgagcttccaaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaa

SEQ ID NO: 146703 - DNA, 7565 bp, Homo sapiens
  Payload ID: 9022
  Gene Symbol: KIF1B
  Gene Name: kinesin family member 1B
  Uniprot ID: O60333
  ENST ID: ENST00000377093
  CDS Start-End: 154-3615
cccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaaaaaaaaaaaaaaaaaaggtaatatttattatattattcaggtttcaactctgtagcaaaaatgggctctcatttccctaacttgagataacatagggtaggtccatatattttcattcttacagtggtcttttcatgggagtgaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcatttctgagcaaatgcttatcctagagaataactctgtatgaataaaattgcttaattgagtctcttactaaataagtaactagtgccatgcttttgtgagctcttggtatggcccatattactttgttttttgtttttgttattgttgttttgtgatagtcttgctctgtcgcccaggctgcagtgcagtggcacaatctcagctcactgcaacctctgcctcctgggttcaagcaattctcctgtctcagcctcctgggtagctgggactacaggtgcatgccaccatgcctggctaacttttgtatttttagtagagacagggtttcaccacgttggtcaggctggtctcgaattcctaacctcaggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttattctattgaagttatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgaccttttgtgctttaggtgcaggttgacactgaaaaaaaaacaaaacactgaatttttcacacctatgtctgcattaaaggctgttttactaccggaagttacatagacttcctgcagtcagctgctgtgccccagtgccttactggtcctttgtagatttgccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttagtttgtaatgttaaaaaataaagacctcattcaataaaagttgaagtcatcttttaa

SEQ ID NO: 146704 - DNA, 8624 bp, Homo sapiens
  Payload ID: 9022
  Gene Symbol: KIF1B
  Gene Name: kinesin family member 1B
  ENST ID: ENST00000620295
  CDS Start-End: 1-5430
atgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgataatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgc

SEQ ID NO: 146705 - DNA, 8588 bp, Homo sapiens
  Payload ID: 9022
  Gene Symbol: KIF1B
  Gene Name: kinesin family member 1B
  ENST ID: ENST00000622724
  CDS Start-End: 1-5394
atgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtggataactgcactagcaagagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgc

SEQ ID NO: 146706 - DNA, 2098 bp, Homo sapiens
  Payload ID: 9022
  Gene Symbol: KIF1B
  Gene Name: kinesin family member 1B
  ENST ID: ENST00000635499
  CDS Start-End: 1-1496
ctgcagttgatgccatcctctccctaaatattatttctgccaagtacctgaagtcttcccacaactctagcaggctctttcttgataaggatattcctaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattc

SEQ ID NO: 146707 - DNA, 7919 bp, Homo sapiens
  Payload ID: 9023
  Gene Symbol: KIF1C
  Gene Name: kinesin family member 1C
  Uniprot ID: O43896
  ENST ID: ENST00000320785
  CDS Start-End: 358-3669
ccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagctatcctactctgtggaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggactgtggctgccaccaacatgaatgagaccagcagccgttcccatgccgtctttaccatcgtcttcacacagcgctgccatgaccagctcacggggctggactcggagaaggtcagtaagatcagtttggtggaccttgctgggagtgagcgagccgactcctcaggggcccggggcatgcgcctgaaggaaggagccaacatcaataagtccctgactacactagggaaagtgatctcggcccttgcagatatgcaatcaaagaagcgaaagtcggattttatcccctacagggactctgtgctcacctggctgctcaaggaaaatttgggggggaactcacgcacagccatgattgcagccctgagccctgctgacatcaattacgaggagactctcagcaccctcaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccaccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccatattggccaggctggtctcgaactcctgatgacctcaagtgatccgcccaccttggcctcccaaagtggtgggattacaggtgtgagccaccgcgcccggcctcccctgctttcatgtttgcttacccagtgtctcagtctgtgccagcagcaccactgtctgttatggacaaagcacagaagcggggatgcgaggggaggtagagggaccgccagcctgtcaatgcttaactggctgttgctgacagatacagaaggatttgtggggtacagaggagttctgctttaagtcacctaacttacttgaaaggtctcccaagcagccagtttctcttgatagtgaatgggttgggcaagcatactgcgcttacctgattgttttcatcctggttgtgttacctgccttctggcaggctacatcattgttcccagtcgttattttatttgtgttaagactgtttgttggccaggcgcagtggttcacgcctgtaatgccagcactgggaggccgaggcaggtggatcacgaggtcaggagatcgagaccatcctggctatcatggtgaaaccccatctctactaaaaataaaaataaaaaaattagccgggcatggtggcgggggcctgtagtcccagctactcaggaggctgaggcaggagaatggcatgaacctgggaggcggagcttgcagtgagctgagattgcgccactgcactccagcctgggcgacagagcgagactccatttcaagaaaaattaaaaaactgtttgttgcctgcttgttttaatgttctggcttgaggcagcgagcccttgactatgccacattgccaggattttgcaggttagattgtactacagcactgcctttggcttgccagactctggagtccccacattttcatcctgttctcaggaaaacactttgacccacttgaagctctgagctactgcttcacagcttcctggggtcagtctccagccaaaaccatagatatcccaactgcagccaaaccacggctctgggcgaaggaacgattaggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttaccgagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatagtgaaaccctgtatctacaaaacatagaaaaactagttgggtgtggtggtgtgtacctgtagttccagctactagggaggtaggaagatcacctgagcccatggagattgaggctgtggtgagctgtgaaggcaccacagcactctggcctgggcaagagtgggactctctcaaaaaaaaaaaaaaaaaaaaatccacatatccagccttccaagtcagtctttaataatgtgcacgggccaggcacagtggctcacacccgtaatcccaacactttggaatattagggtgggagcatcacttgaggccaggaatttgagaccagcctgggcaacatagtgagactgccccccccatctctacaaaaaataaaaatcaaaaataatactgtgggcaaactttacttagattttattcagagtagtgcctgtttatttttcatctgtgctacctgtgccggcattccatatgcatttgatttagtctttaaagtaccccggtaaaataggtcttttgtctgcatttttcagatgggaagactgaggttttgtttatttatttttatttatttattttttgagacggagtctcgctctgttgcctaggctggagtgcgatggcacaatcttggctcactacaacctccgcttcctgggttcaagcgattctcctgcctcagcctcctgagtagctaggattacaggcgcccacaaccgcacccggctaattttttgtatctttagtagagacagggtttcactatgttgtccaagctggtttcgaattcctgacctcaggtgatccacccgcctctgcctcccaaaatgttgggattacaggcgtgagccaccacgcccagcctatttatttatttttttagaatcaagatcttgctatgttgcccaggctgaactcgaactcctgggctcaagcaatcctgcctcccaagccaagcagctggtactgcaagcatgtgccaccgtgcctggctcctgaagactgaggttggtttagattaatgagttgcccaaattcagacagttcttaagtggcaaagttaggattccaacccaggtcaacataactaaagcccaaaccccatctcacccctctaggccatcaagtattggctgggtgcggtggtttatgtctgtaatcccagcactttgggaggcggaggcgggaggactgtttgagctcaggagtttgagaccagcctgggcaacataacaagaccctgtctctacaaaaatatataaattagccgggtgtactggctcacacctgtagctacttgggaggctgaggtgggaggatcgcttgagcctgggaggtcaaggctgcggtgacctgtgattgcaccaccaggagaccctgtcttaaaaatgtatatataaaaataaaaagaacatcagacatcaccatcacctcgcttagaatccatggggccttctcctcaaattcaatcttcccaggcatttcatgaacttgcgtctagtttctgttccctctcaaattgcccaggctgtcctgtgagtgacagcagctatttcgtgggcctcctctggaatcatgagaagtcacccaaacaatctcagttttctagctcactccgtcttgacatttctacactgtcatccttggttttcttggaaattaatttgcttttcttcattgtctttctttggagctgctttccttttgttggttactattttatttttagcttctcacaccataccgacatatgttggttattcttttagacatgttttttgttgttgttgtcacctggaacttttgtatcttgaataaatttggggatcaaataca

SEQ ID NO: 146708 - DNA, 799 bp, Homo sapiens
  Payload ID: 9023
  Gene Symbol: KIF1C
  Gene Name: kinesin family member 1C
  ENST ID: ENST00000574165
  CDS Start-End: 386-799
cgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgagggaggccccagggaccctctaccctcaaacacagggtatctcccagagccccagctggtgtggccaggccccaggagtaggatggggctccccctacgagggccggtggcagccagaactgatacagcccccctggtctggggccaggacgccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctccatcatcaatcctaaacagagcaaggatgcccccaaaagcttcacctttgactactcctactggtcacacacttcgacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccagctctgtgaggacctcttctctcgcgttagtgagaaccagagtgctcagcta

SEQ ID NO: 146709 - DNA, 3201 bp, Homo sapiens
  Payload ID: 9024
  Gene Symbol: KIF20A
  Gene Name: kinesin family member 20A
  Uniprot ID: O95235
  ENST ID: ENST00000394894
  CDS Start-End: 227-2899
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaaggga

SEQ ID NO: 146710 - DNA, 2935 bp, Homo sapiens
  Payload ID: 9024
  Gene Symbol: KIF20A
  Gene Name: kinesin family member 20A
  Uniprot ID: O95235
  ENST ID: ENST00000508792
  CDS Start-End: 65-2683
gagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacatttt

SEQ ID NO: 146711 - DNA, 631 bp, Homo sapiens
  Payload ID: 9024
  Gene Symbol: KIF20A
  Gene Name: kinesin family member 20A
  ENST ID: ENST00000513276
  CDS Start-End: 154-631
gaaatgtcgtttttccccttaagacaaagcaagcaccctaaaccagttaccctgtgcactcctgttaagattgttgctaaggaaggacaggagttggctgctgaagcctcaagatttcctttaggctcttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatg

SEQ ID NO: 146712 - DNA, 810 bp, Homo sapiens
  Payload ID: 9024
  Gene Symbol: KIF20A
  Gene Name: kinesin family member 20A
  ENST ID: ENST00000504621
  CDS Start-End: 135-810
tggagcccgggttaccagctcttgcccgcgcggaataggctttaagaaatcggagctgcagccatctgtttttctcttaatgctgcatctctgttctcacggtggtccttgggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgt

SEQ ID NO: 146713 - DNA, 600 bp, Homo sapiens
  Payload ID: 9024
  Gene Symbol: KIF20A
  Gene Name: kinesin family member 20A
  ENST ID: ENST00000502338
  CDS Start-End: 1-249
gccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccagg

SEQ ID NO: 146714 - DNA, 6306 bp, Homo sapiens
  Payload ID: 9025
  Gene Symbol: KIF20B
  Gene Name: kinesin family member 20B
  Uniprot ID: Q96Q89
  ENST ID: ENST00000260753
  CDS Start-End: 73-5415
attgtttgaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctt

SEQ ID NO: 146715 - DNA, 6419 bp, Homo sapiens
  Payload ID: 9025
  Gene Symbol: KIF20B
  Gene Name: kinesin family member 20B
  Uniprot ID: Q96Q89
  ENST ID: ENST00000371728
  CDS Start-End: 66-5528
gaatttgaaaacggtaacatcgcagtgctgctcgcgggtctggctagtcaggcgaagtttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggttactgtgcataatgatagtgatgatactctttatggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaagatctacaatggattcaagtatctgattccaaagaagcctatagacttttaaaactaggaataaagcaccagagtgttgccttcacaaaattgaataatgcttccagtagaagtcacagcatattcactgttaaaatattacagattgaagattctgaaatgtctcgtgtaattcgagtcagtgaattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagaaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaaggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatgaatcagattcattgattcaagagcttgagacatctaataagaaaataattacacagaatcaaagaattaaagaattgataaatataattgatcaaaaagaagatactatcaacgaatttcagaacctaaagtctcatatggaaaacacatttaaatgcaatgacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaaattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtatctgtaatgcgtgatgaggataaattactgaggattaaaattaatgaactggagaaaaagaaaaaccagtgttctcaggaattagatatgaaacagcgaaccattcagcaactcaaggagcagttaaataatcagaaagtggaagaagctatacaacagtatgagagagcatgcaaagatctaaatgttaaagagaaaataattgaagacatgcgaatgacactagaagaacaggaacaaactcaggtagaacaggatcaagtgcttgaggctaaattagaggaagttgaaaggctggccacagaattggaaaaatggaaggaaaaatgcaatgatttggaaaccaaaaacaatcaaaggtcaaataaagaacatgagaacaacacagatgtgcttggaaagctcactaatcttcaagatgagttacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagaaacacaaatcatggatatcaagcccaaacgtattagttcagcagatcctgacaaacttcaaactgaacctctatcgacaagttttgaaatttccagaaataaaatagaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggacttggtgaaatgtgaaaataagaagaatgctacacccagaactaatttgaaatttcctatttcagatgatagaaattcttctgtcaaaaaggaacaaaaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtgattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctt

SEQ ID NO: 146716 - DNA, 660 bp, Homo sapiens
  Payload ID: 9025
  Gene Symbol: KIF20B
  Gene Name: kinesin family member 20B
  ENST ID: ENST00000447580
  CDS Start-End: 41-660
aggtgaggaggtgacccgcgggaatgtgtggggaaggagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggcaaacagtttcgaatctaaagattatctccaggtttgtcttcgaataagaccatttacacagtcagaaaaagaacttgagtctgagggctgtgtgcatattctggattcacagactgttgtgctgaaagagcctcaatgcatccttggtcggttaagtgaaaaaagctcagggcagatggcacagaaattcagtttttccaaggtttttggcccagcaactacacagaaggaattctttcagggttgcattatgcaaccagtaaaagacctcttgaaaggacagagtcgtctgatttttacttacgggctaaccaattcaggaaaaacatatacatttcaagggacagaagaaaatattggcattctgcctcgaactttgaatgtattatttgatagtcttcaagaaagactgtatacaaagatgaaccttaaaccacatagatccagagaatacttaaggttatcatcaga

SEQ ID NO: 146717 - DNA, 6601 bp, Homo sapiens
  Payload ID: 9026
  Gene Symbol: KIF21A
  Gene Name: kinesin family member 21A
  Uniprot ID: Q7Z4S6
  ENST ID: ENST00000361961
  CDS Start-End: 421-5406
gaggagcccggagcgccctggcgggcgtggagtccccagcctggccgctgggaggccgcgtccccaccggagggggcagggcgcactcacccggccgccctgaggccgctggcggcctgttggcttctccacaggcgcgctcgccgttcaagcgcgctttgtccccgccccagatcctggggggtgagcggtggagaaggggcgggcgcccgcgagccgtgaatcacctcctcctcttgctgcctcagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaatt

SEQ ID NO: 146718 - DNA, 5044 bp, Homo sapiens
  Payload ID: 9026
  Gene Symbol: KIF21A
  Gene Name: kinesin family member 21A
  Uniprot ID: Q7Z4S6
  ENST ID: ENST00000361418
  CDS Start-End: 17-5041
gctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaaggctacagaaacttgaggaaagcaatcgagaagaaagaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaaca

SEQ ID NO: 146719 - DNA, 4866 bp, Homo sapiens
  Payload ID: 9026
  Gene Symbol: KIF21A
  Gene Name: kinesin family member 21A
  Uniprot ID: Q7Z4S6
  ENST ID: ENST00000541463
  CDS Start-End: 1-4866
atgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatgttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaa

SEQ ID NO: 146720 - DNA, 5040 bp, Homo sapiens
  Payload ID: 9026
  Gene Symbol: KIF21A
  Gene Name: kinesin family member 21A
  Uniprot ID: Q7Z4S6
  ENST ID: ENST00000544797
  CDS Start-End: 90-5003
agcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtga

SEQ ID NO: 146721 - DNA, 593 bp, Homo sapiens
  Payload ID: 9026
  Gene Symbol: KIF21A
  Gene Name: kinesin family member 21A
  ENST ID: ENST00000551066
  CDS Start-End: 1-417
aaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattaggtaagtatgtttagctttctgtgtatcctacagctgcatgaattactaattgttcatgtacactaattgtggtacatcttattttaaagatttttattggcggtcaagtggtttttgcatgatcttttttgaaatgtatccatgcccacaaacacactaagtcttttattaaacattcctgattttaaaa

SEQ ID NO: 146722 - DNA, 4120 bp, Homo sapiens
  Payload ID: 9026
  Gene Symbol: KIF21A
  Gene Name: kinesin family member 21A
  ENST ID: ENST00000552961
  CDS Start-End: 1-2927
aaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcagtctgatgaaagtgactcctctctctcggaggtacacaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaa

SEQ ID NO: 146723 - DNA, 3161 bp, Homo sapiens
  Payload ID: 9026
  Gene Symbol: KIF21A
  Gene Name: kinesin family member 21A
  ENST ID: ENST00000551264
  CDS Start-End: 1-1968
caacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcagggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaa

SEQ ID NO: 146724 - DNA, 3005 bp, Homo sapiens
  Payload ID: 9026
  Gene Symbol: KIF21A
  Gene Name: kinesin family member 21A
  ENST ID: ENST00000547108
  CDS Start-End: 1-1427
caaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatgtaagtttggcccagctacactaacttcttttcttttggctttaaaaaaaaaagtatgcatgttgctaatttcttatttctattatttaaaatttatataaatttgatctctggttttcgaaataatttgctaggtgttgtctcccctaaggtattggagagttgaaataatttaagatgagatgtcctttgttgaattgctttgtcttgtctccaagttttaggatcattcttaagggttataatttttataaaggctgacttatgaattacagaaaatacatatatagaaatacctaaattaaagttatacctataaaaccattatataactattatgtataaacagaaagtttagactcttaaatttgctctaaattacctatatcctagttttaagagtcctgtcaggatagtaaatgtttgctgacttttaaagaaaaaagaaaataccaattacaagtttaatacattttgagctttcctaattttttaccttgaagcatattgcatattctgggatgagtgtatgccccaaaaatatttttattggtattattaaagatttgaaggaggaaatattctctttcctatgataatctgaacaaaaaaccttctattcaaaataaatcttgcatagactatttttaattattatcttgaggacaaagaaagattttcccacatagtcctgtgtgtgtatgcgtatgtgtatgtgtgtgtgtacatatgtgtaccatgtgtgcatgtgtgtgttttgatagttatattaatattagattagtcattcactggtaaagatttttaacgttatttttcaaactaatcctcacatgtgatctagcagataatttatggaatgaatacatctctgcactgaggaatattgcccccccaaaagtggcacacactatatgatctgtaaataatacaaaataacaaactttccaaacttgaatagccatttttcataatattcttcattttatgaggacatttccattgttttccattcagtatcccatctgctaccttttgttccagaattaattttaatgatggcagaactttcttgcatgtgcttgaggtggcctatgtaattaactgttggatctgctgttagagattgctaaccagaatagtttatggcttcattgcttttgtgataagatgagaatagaagaaatgcttttggtgaaggtagtgatgtagaactgaggtcagattttaggaactaaatgtgttaggtatttagtctgtcagatgagtgagacttttggaacttcaagactaaatctgtggcctggaatccagattcagttccaggcagtcatctctatcagaaaaaaaaattccagagccttctcctgtaacaaggagaaaggcatatgagaaagcagaaaaatcaaaggccaaggaacaaaagcagggcataatcaacccatttcctgcttcaaaaggaatcagagcttttccacttcagtgtattcacatagctgaagggcatacaaaagctgtgctctgtgtggattctactgatgatctcctcttcactggatcaaaaggtatcgtacttgtaaag

SEQ ID NO: 146725 - DNA, 871 bp, Homo sapiens
  Payload ID: 9026
  Gene Symbol: KIF21A
  Gene Name: kinesin family member 21A
  ENST ID: ENST00000552908
  CDS Start-End: 1-871
tatactgtgggcgttacaacacgtactgtgaatacagaatcagagtccttgtttcttcccctttttcagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagag

SEQ ID NO: 146726 - DNA, 9897 bp, Homo sapiens
  Payload ID: 9027
  Gene Symbol: KIF21B
  Gene Name: kinesin family member 21B
  Uniprot ID: O75037
  ENST ID: ENST00000332129
  CDS Start-End: 318-5192
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaagaaaacccatgacaaagctcccctgggggcctctgagtgcacaggcctctccatctgcccagcaccccaccacctgcagtccacctccccgtaagccatgcttgcctcccagccccaaccacatttggggagtttggggaatccagttcatcctctacttttgggggcagccagccaagcccactgcaagagctgaccggcacccctccactttgtcctccaccccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcttcccctatattctttccctcagctcttgggggccagaaatcccaaagggagtccgctgccccggccctccagggccgcctcctctgtttgctttgcagaggagggaactgctccttcgactctgcagctcaggcctgtccccgacacagcccccagggagtcttctagctacccctggcctctaggccgcctgacgctcagtgccttcctccgttccggggcctggcacccgtgccgggcagccttacaccagccatgcccgcggcaccacatgtgtcttctcactcgcgaggtcttgtgcccagcgcccccgggaaggcgggggcgctcaccccacagcccaggccccggggttctgccccacagtcctgcgtgggccacgtaggaagcagcatgggggctgtgtctgctgggaggtggcttggatggggaggacagcccggcaccctgacccccgcccctccccagccctgcagtcccccactgggccggggagtctctccagcttctctctctctggttattcaggagacacattttcggccttaaaactggcatggagcgcaggccctcccttgcagaaaattatcaaggaagagggagttggcagagtttctctgccccggggctggggacgcggagctccggggaaattgttaaatcagtgttctggcgccccctgttgggggaactctggaattacaggagtgggccttgggggggactgagctccatccctctcccccgccccacccccacccaaagttgcccaccctgtttttccgttgcatcgctggtcttgtgcttcccgcttcagtctgggagccaagagccagccccacctcccttcagaggacgcagtgacttttggactttccagaggtggttctgtgtttctgcccttggctcctctccgtcttgggctggggcacttggagccctctccatgtggcgcccagtgttggggggaggcaggctccagtggaggctgagtgaggcctggtcccttccccgtgccctcctcggagctgccacagaggctaagacggctgtcctgctggtgctggccctgctggatgtggtattgaagtctggggcagctgatagcaggaaggagacccccttggatgctggtctcctgggacctgaacagtctgtcagcaatggctggaaatccttcttcctctggccaccccgggggtgccgggcaacccccttagctctaagatgtggccacaaatctcttcccactcctccccgccaacctgaacagaaagttttgaccttgcaacctgtaagaaagaatccgtccgcatgactgtttacaagcgatagaaacacgtaagactctgtccccttgagctcccacccccgggccggggatgccccacctggggtgactgcactgtagctgcaaggcgtgttcttgcacgaagtgtgatcttatggccctgcgagaggtgctcatcatcatgcccattttctgctgtttctgatgggtcagctacctcacggcggggccagctctgctgtcctggcaagtgtcattgactctctaaacttgaagtccttcaggagccctgagcccaacatccatgagacaccccgagttgtgcttcatgagagttggattctctgcccactctttcagggatgtccaaggtccatgttagggggcaggcccccagctccactcactgcacaagcaccctaaatgttggaagcacaaaatggttgtgatttgagcacaatggcagggtcccgcaggcagacttgacaggcccaggcccgggaggatccccccacgttggctctgtccaaagtgagattgggggtgcctgtgtctgggacagggggctgcccttgctcagaccaggccttggctcatggcttgtcctaattctgggactcgtcatcttacttcttgcccttctgtgcccatcttaagactggaggctgagccttgtcaggcccagccacatctttacgccatgggaccaggagtaaagcgctctctaaaccccgcaccccaaatctctaaacgcctgagttcaggctgagtcctagccctagtgagcctgaagagcttggactgattcccagtctcctgggtcaagccccactttgtgctttcgaagcttatgagcgggttccctggatagaaggagtcttccatccccactgcccttgggcctcttcagcatagtcctgtgccagggccctgtcctcactatcagtcagttcagtatttgctttcacgtgagtggcggactcttctgaagcagccagaactctcaaaggcagcgcatggagttgccttgcgagatttccaaggaaggaggaaagattaacaggcggagcctggcacacccaagcctttgaggtggtcagagtgccaccttcagccccttgggaagggacagcggtgggtctgggagtggcctcaccctggattcagcctaggaatctcttcaccctcagctgtccagccctgctgcctgtctggggatgtgtggcctgggcagagggcagtttaaagcacaaaaccacatggggaaaacacaaggttgcggggactttctcatgtgcctgatgtggtggagggagacaccagcaggtggctgcagtgacgttagggaacataacacttctttgccctgctagctctcagctctggggggcatcccccgatgtggtctgggctgggagcaggcatatcccctggttgttgcctgtgcctggtctgttcaccatcgtgtttgtgtgggcagagcctgccctgcaggagcagtgactttcttcccactgtgtgtcccggacctgtggtatgtgtccctttgccatcccaaacaggcaactgcttgctgctctccttgcttggcatagcctcctggtcagtggccaatgccccacaggccttcctgggcctggccctcctctcctgactcccagatccttccctgccctcttgtgtgcaaggacagattttgcagggaaagttctgtttcttctttgatacctttgttctgtcccctgccccatccccagcactcatgatcttgaagcccctatcacactctagttcagtcctgtgaaccatgtcctgagggccttgcagggaagtaggaaatagaaactcctccacaaagagccgaggatcagagaagacccctgagatgaatcagggccctgccctgcccaccaactcttttctagcaatcatgtcctgcccaggctgcaggcttcattaggctcctgctgtcctccatgatgtgactagcacaaggtgtatatatgttttgtacctctgccgatggctgtacatagtgtatgaaagttatttaagccccatgttgtacatttctgttcctagattggatgtgtgtgttctaagaagttgtcataaataaaacctgaatgaccaa

SEQ ID NO: 146727 - DNA, 5389 bp, Homo sapiens
  Payload ID: 9027
  Gene Symbol: KIF21B
  Gene Name: kinesin family member 21B
  Uniprot ID: O75037
  ENST ID: ENST00000360529
  CDS Start-End: 26-4858
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 146728 - DNA, 5519 bp, Homo sapiens
  Payload ID: 9027
  Gene Symbol: KIF21B
  Gene Name: kinesin family member 21B
  Uniprot ID: O75037
  ENST ID: ENST00000422435
  CDS Start-End: 318-5231
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcctcgggcattggcccccagacccccgcctctgatccacgcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgactgccgggtaaagttgtggaattacgtccctggactcaccccctgccttcctcgccgagtcctggccataaagggccgcgccaccaccctgccctgaccctccccaactctccctgtctcctctttcattcttcccctctttccttttccctctctttccccacttcgatctgagctgcttcttaacggtatgagattattttactccttcttcttcctttcccttcctgtcctgcctggcctagagaggtgccctgcctgtccctcctgcacccaccgtccttttccaagcatgaacagtgggacaggccccaggagatgggtgccagggagcagaagggggagccttcaggcctggacaaaacgaaacacccccccaaaaaaa

SEQ ID NO: 146729 - DNA, 5428 bp, Homo sapiens
  Payload ID: 9027
  Gene Symbol: KIF21B
  Gene Name: kinesin family member 21B
  Uniprot ID: O75037
  ENST ID: ENST00000461742
  CDS Start-End: 26-4897
gcccagaccctagctccagagggccatggccggccagggggactgctgcgtcaaggtggccgtcaggatccggccccagctgtcgaaggagaagattgagggctgtcacatctgtacctctgttaccccgggagagccccaggtcctgctggggaaggacaaggccttcacctatgactttgtcttcgacctggacacctggcaagaacagatctattccacctgtgtgagcaagctcatcgagggctgcttcgagggctataatgccacggtgctggcctatgggcagacgggggccgggaagacgtacaccatgggcactggctttgacatggcaacgtcggaggaggagcagggcatcatcccgagggccatcgcacacctctttgggggcattgccgagcgcaagcgccgggcacaggagcagggcgtggctggacctgagttcaaagtcagcgcccagtttctggagctctacaacgaggagatccttgacctgtttgacagcacccgtgaccctgacacccgccaccgcaggtccaacatcaagatccacgaggacgcaaacggtggcatctacaccactggcgtcacttctcgcctcatccactcccaggaggagctgatccagtgcctgaagcagggggccctgtcccgcaccacagccagcacccagatgaacgtgcagagctcacgctcccacgccatcttcaccatccacctgtgccagatgcgcatgtgcacccagcccgacctggtgaatgaggcggtgactgggcttcctgatggtacacctccctcgagtgagtatgagacactcactgctaagtttcactttgtggacctggccggctcagagcggctgaagcggacaggggctactggcgagcgggccaaggagggcatctccatcaactgtggcctgctggccttgggcaatgtgatcagcgccttaggggaccagagcaagaaggtggtgcacgttccctacagggactccaagctcactcggctcctccaggattcgctggggggcaacagccagaccatcatgatcgcctgtgtgagcccctcagaccgagatttcatggagaccctcaacacactcaaatatgccaatcgggcccgcaacatcaagaacaaggtggtagtgaaccaggacaagaccagccagcaaatcagtgcactgcgggctgagattgctcggctgcagatggagctgatggagtataaggcgggcaagcgagtgataggagaggatggcgctgagggctatagtgatctgttccgagagaatgccatgctacagaaggagaatggggccctgcggctgcgggtgaaagccatgcaggaggccatcgatgccatcaacaaccgcgtcacccagctcatgagccaggaggccaacctgctgctagccaaggccggcgatggcaatgaggccattggtgcgctgatccagaactacatccgggagatcgaggagctacggactaagcttctagagagtgaagccatgaacgagtccctgcgccgcagcctctcacgggcctcggctaggagcccctactccctgggtgcttctccagccgccccggccttcgggggcagccctgccagctccatggaggatgcctcggaggtgatccgcagggccaagcaggacctggagcggctaaagaagaaggaggtcaggcagcggaggaagagccccgagaaggaagccttcaaaaagagggcaaaactccaacaggagaacagcgaggagacggatgagaacgaggcggaggaggaggaggaagagcgagacgagagtggctgtgaggaggaggaagggcgcgaggatgaagatgaggactcgggcagtgaagagagcctggtggactcagactcagaccccgaggagaaggaggtgaacttccaggcggacctggccgacctgacttgtgagatcgaaatcaagcagaagctgatcgacgagctggagaacagccagcggcggttgcagacgctcaagcaccagtatgaggaaaagctgattctgctgcagaacaagatccgagacacacagctggagcgcgaccgtgtgctgcagaacctcagcaccatggagtgctatactgaggagaaggccaacaagatcaaggcagactatgagaagaggctgcgggagatgaaccgggacctgcagaagctgcaggccgcccagaaagagcacgcccggctgcttaagaaccagtcgcgctacgagagggagctgaagaagctacaggccgaggtggctgagatgaagaaggccaaggtggccctgatgaagcagatgcgtgaggagcaacagcggcggcggctagtggagaccaagaggaaccgggagatcgcacagctcaagaaggagcagcggcgacaggagtttcagatccgagctctggagtcccagaagcggcagcaggagatggtcctgaggaggaagacccaggaggtttctgcactgaggcgcctggccaagcccatgtctgagcgggtggcagggcgtgcaggactaaagccacccatgctggactctggggctgaggtgtcggccagcactacctcatctgaggctgaatcaggggcccgctctgtctccagcatcgtgcgccagtggaaccgcaaaatcaaccacttcttgggggaccatcctgcgcccactgtcaatggcacccgtcctgcccgaaagaagttccagaagaagggggccagccagagcttcagtaaggcggcaaggctcaagtggcagtccctggagcgacggatcattgacatcgtcatgcagagaatgaccattgtcaacctggaggctgacatggagcggctcatcaagaaaagggaggagctgttcctcctgcaggaggcactgcggaggaagcgggagcggctgcaggctgagagccccgaggaagagaaggggctgcaggagctggctgaggagatcgaggtgctggcagccaacattgactacatcaatgacggcatcaccgactgccaggccaccatcgtgcagctggaggagaccaaggaggagctggactccacagacacatccgtggtcatcagctcctgctccctggctgaagcccgcctcctgctagacaacttcctcaaggcatccattgacaaggggctgcaagtggcacaaaaggaagcccagatccggctgttggagggccgactgaggcagacggatatggcaggctcctcccagaaccatctgctcctggacgccctgcgtgagaaggctgaagctcaccccgagctgcaggccctcatctacaatgtgcagcaggagaatggctacgccagcacagatgaggagatctcagagttctctgagggcagcttctcccagtcattcaccatgaaaggctccaccagccatgacgatttcaagttcaagagcgagcccaaactgtctgcccaaatgaaagctgtgtcggctgagtgcctgggccccccactggatatctccaccaagaacatcaccaagtccctggcctccctcgttgagatcaaagaggacggagtgggcttctctgtccgagacccctattaccgggacagggtctcgcgcaccgtcagtctgcctacccggggcagcactttccctaggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctccatggccgaaggccacaccaagcccatcctctgcctggatgccacagatgagttgctattcacagggtccaaagaccgaagctgcaagatgtggaacttggttacgggacaggagatcgcagctctaaagggccaccccaacaacgtggtctccatcaagtactgcagccactcggggcttgtgttctccgtgtccacctcctacatcaaggtgtgggacatccgggactcagccaagtgcattcggactctcacgtcctcgggccaggtgatctcaggggatgcctgtgccgccacatccacccgtgccatcaccagtgctcagggcgagcatcagatcaaccagatcgccctcagcccttcgggcaccatgctgtacgccgcctcgggcaatgccgtccgcatctgggagcttagcaggttccagcctgtcggcaagctgactggccacatcggccctgtgatgtgcctgacggtcacccagacggccagccagcatgacctcgtggtgactggctccaaggaccactacgttaagatgttcgagctgggcgagtgtgtgacgggcaccatcggccccactcacaacttcgagcccccgcactacgatggcatcgagtgtctcgccatccagggagacatcctgttcagtggctcccgagataacggcatcaagaagtgggacctagaccagcaggagctcatccagcaaatccccaatgcgcacaaggactgggtgtgcgccctggccttcatcccgggccgccccatgctgctcagcgcctgccgtgcgggtgtcatcaaggtctggaacgtggacaacttcacacccatcggtgagatcaagggccacgacagtcccatcaatgccatctgcaccaatgccaagcatatcttcacagcctccagtgacctgacggtgaagttctggagtgtccggcggttaccccacagcggcccaccctaggagtgaggtcagagggatgcccccggaccctcgaccccagcagcctggacaccatggaagggaagctgtgacccggccgatggggccagctgctctggggacagagggcgtggccccctctcctgccctcctccctctcccttggccttcccacaggacactgttccctcatccctcccctgcctctcaggagcctctgggtgagagagaggctggggaggaaattaagctgtgaagccaaagggcattatcccttcttgttcccctcctggcagtcgtggccacattgtctcctgctgaaccggctctgcccctttctcaggcctttggcccagtggtggagccctgtggggaggtgcagcagcctggccccatcccacccttccgaggagctggcctccccgcttctcccagcccagcctctagagccactgcacctgcctctgagcccaaaaagataagtcctcaggtagctaaggaaaccaggtgtgggcggctgggccttgcagctaacccttaaccctctggcaa

SEQ ID NO: 146730 - DNA, 2113 bp, Homo sapiens
  Payload ID: 9028
  Gene Symbol: KIF22
  Gene Name: kinesin family member 22
  Uniprot ID: Q14807
  ENST ID: ENST00000160827
  CDS Start-End: 41-2038
ggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggtg

SEQ ID NO: 146731 - DNA, 2493 bp, Homo sapiens
  Payload ID: 9028
  Gene Symbol: KIF22
  Gene Name: kinesin family member 22
  Uniprot ID: Q14807
  ENST ID: ENST00000400751
  CDS Start-End: 626-2419
gtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggcgtgtattgggaagggttctgtgtgggacatggtgtttgggtgcagagacatccctgagagatgcaagaggacgggctgaggaacagacccggctgctgctgggtttgagttggcagcgtaagatgctctgcgattacaggaaaacgaaataaaagactaaaatttcctttcactctagcatggaagtgaatgctattttagggttggaaaggctgttaggacacccaaaatcttgtatgagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggt

SEQ ID NO: 146732 - DNA, 2505 bp, Homo sapiens
  Payload ID: 9028
  Gene Symbol: KIF22
  Gene Name: kinesin family member 22
  Uniprot ID: Q14807
  ENST ID: ENST00000561482
  CDS Start-End: 638-2431
gggaattcgaatgggagaggcgggcccaaggagggagtggaatggccgcgggcggctcgacgcagcagaggcgacgcgagatggcggcagcttcagcggcggcgatctcaggtacttgagcccggcctgggcaaggcgggtaccgacgtctggagtttagtgggagttatgtgtcggagtgtggtccaggctctgcgggttgtcgcggagaggcggccatggcgcaggggcggggagagggggacggtgagagtgtggggtcgcgagccggtcgccccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccggt

SEQ ID NO: 146733 - DNA, 562 bp, Homo sapiens
  Payload ID: 9028
  Gene Symbol: KIF22
  Gene Name: kinesin family member 22
  ENST ID: ENST00000570173
  CDS Start-End: 7-276
agtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggt

SEQ ID NO: 146734 - DNA, 2020 bp, Homo sapiens
  Payload ID: 9028
  Gene Symbol: KIF22
  Gene Name: kinesin family member 22
  ENST ID: ENST00000569382
  CDS Start-End: 142-1977
cctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagatcgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtggaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaactggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccc

SEQ ID NO: 146735 - DNA, 834 bp, Homo sapiens
  Payload ID: 9028
  Gene Symbol: KIF22
  Gene Name: kinesin family member 22
  ENST ID: ENST00000569636
  CDS Start-End: 280-834
agaggcgggcccaaggagggagtggaatggccgcgggcggctcgacgcagcagaggcgacgcgagatggcggcagcttcagcggcggcgatctcagcaaatacttcttgagggcctactctgcgccaggtgttggggttagaaaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaag

SEQ ID NO: 146736 - DNA, 781 bp, Homo sapiens
  Payload ID: 9028
  Gene Symbol: KIF22
  Gene Name: kinesin family member 22
  ENST ID: ENST00000568312
  CDS Start-End: 1-219
gctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccg

SEQ ID NO: 146737 - DNA, 3713 bp, Homo sapiens
  Payload ID: 9029
  Gene Symbol: KIF23
  Gene Name: kinesin family member 23
  Uniprot ID: Q02241
  ENST ID: ENST00000260363
  CDS Start-End: 221-3103
ttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcact

SEQ ID NO: 146738 - DNA, 3351 bp, Homo sapiens
  Payload ID: 9029
  Gene Symbol: KIF23
  Gene Name: kinesin family member 23
  Uniprot ID: Q02241
  ENST ID: ENST00000352331
  CDS Start-End: 163-2733
gccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaata

SEQ ID NO: 146739 - DNA, 3357 bp, Homo sapiens
  Payload ID: 9029
  Gene Symbol: KIF23
  Gene Name: kinesin family member 23
  ENST ID: ENST00000395392
  CDS Start-End: 174-3032
gtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaa

SEQ ID NO: 146740 - DNA, 1081 bp, Homo sapiens
  Payload ID: 9029
  Gene Symbol: KIF23
  Gene Name: kinesin family member 23
  ENST ID: ENST00000559283
  CDS Start-End: 279-1081
tcctgcctcagcccccctagtagctgggattagaggcacacgccaccatgcccggctaatttgtatttttagtagagacggggtttcaccatgttggccaggctggtcttgagttcctgatctcaggtgatccgcctgcctcggcctcccaaagtgctgggattatagctgtgagccaccatgcccggctgggatcatttacttttaaaatggacttataacgtatacaattgaacttttctttttttagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttggtaattttaatatttgcggaagtgactcaagaagttgaagtagcaagacctgtagacaaggcaatatgtggtttaacgcctgggaggagatacagaaaccagcctcgaggtccagttggaaa

SEQ ID NO: 146741 - DNA, 2296 bp, Homo sapiens
  Payload ID: 9029
  Gene Symbol: KIF23
  Gene Name: kinesin family member 23
  Uniprot ID: Q02241
  ENST ID: ENST00000558585
  CDS Start-End: 164-2185
aaacgatcctcctgcctcagcccccctagtagctgggattagaggcacacgccaccatgcccggctaatttgtatttttagtagagacggggtttcaccatgttggccaggctggtcttgagttcctgatctcagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtggaacagttgcagcacacccatgaggaacacagattttgtacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaa

SEQ ID NO: 146742 - DNA, 3411 bp, Homo sapiens
  Payload ID: 9029
  Gene Symbol: KIF23
  Gene Name: kinesin family member 23
  Uniprot ID: Q02241
  ENST ID: ENST00000559279
  CDS Start-End: 221-2791
ttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaataca

SEQ ID NO: 146743 - DNA, 1656 bp, Homo sapiens
  Payload ID: 9029
  Gene Symbol: KIF23
  Gene Name: kinesin family member 23
  ENST ID: ENST00000558346
  CDS Start-End: 118-1233
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtggaacagttgcagcacacccatgaggaacacagattttgtacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacagttttgggaagctggatatcgaatcttagagcctgaattttgctgtgaaaaaagtttgcaaatctttaaaaatccctttggtagaagtgataaaataagactgtgattttttctctctggcgactccttctgaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacag

SEQ ID NO: 146744 - DNA, 2743 bp, Homo sapiens
  Payload ID: 9029
  Gene Symbol: KIF23
  Gene Name: kinesin family member 23
  ENST ID: ENST00000561089
  CDS Start-End: 142-471
gctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttaccgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttg

SEQ ID NO: 146745 - DNA, 6226 bp, Homo sapiens
  Payload ID: 9030
  Gene Symbol: KIF24
  Gene Name: kinesin family member 24
  Uniprot ID: Q5T7B8
  ENST ID: ENST00000379166
  CDS Start-End: 121-4227
gacgggactgttaggttgcgggctttggggctcactcccgacggcattgtcttctcctcttctcagacagggcagaccgaggagtttggaccgagagtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagatagtgggactgcaagagcttcaggtggacagtgtggagctcctcttagaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 146746 - DNA, 5729 bp, Homo sapiens
  Payload ID: 9030
  Gene Symbol: KIF24
  Gene Name: kinesin family member 24
  Uniprot ID: Q5T7B8
  ENST ID: ENST00000379174
  CDS Start-End: 26-3730
agtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 146747 - DNA, 6131 bp, Homo sapiens
  Payload ID: 9030
  Gene Symbol: KIF24
  Gene Name: kinesin family member 24
  Uniprot ID: Q5T7B8
  ENST ID: ENST00000402558
  CDS Start-End: 26-4132
agtttatagaaacctattcaccaaaatggcatcctggttatatgaatgtctttgtgaagctgaacttgcacagtattattctcatttcactgcccttggccttcagaaaatagatgaattagccaagattacaatgaaggactactccaaattaggagtccatgacatgaacgaccgcaaacgtctcttccaacttatcaaaattattaagattatgcaagaagaagataaagcagtcagtatcccagagcgtcatcttcagacaagcagcctgcgcatcaaatctcaggaattaagatctggccctcgcagacagctgaattttgattctcctgctgacaataaagacagaaatgccagcaatgatgggtttgaaatgtgcagtttatcagatttctctgcaaatgaacagaagtccacttacctaaaagtgctagaacacatgctaccagatgattcccagtaccatacaaaaacaggaattctgaatgccacagctggtgattcctatgtgcaaacagaaatcagcacttcactcttttcaccaaattacctttctgcaatactgggggattgtgatattcccattattcaaagaatctctcatgtttcagggtataactatggaatccctcattcttgtatcagacagaacacttcagagaaacagaatccttggactgagatggagaaaatcagagtttgtgttcgaaaacgccccctgggcatgagggaggtacgtcgtggagaaattaatattattactgtagaagacaaagaaactctacttgtgcatgagaagaaagaagcagttgacctcactcaatatattctgcagcatgttttttattttgatgaagtctttggtgaggcgtgcaccaatcaggatgtatacatgaagactactcacccacttattcagcatattttcaatggaggcaatgccacttgctttgcttatggacagacaggtgctggaaagacctacaccatgataggaactcatgagaacccaggattgtatgctctagctgccaaagatatcttcaggcaactagaagtgtcccagccaagaaagcacctctttgtgtggatcagcttctatgaaatttactgtggacagctttatgacctcctaaatagaagaaaaaggctctttgcaagagaagatagcaagcacatggtgcagatagtgggactgcaagagcttcaggtggacagtgtggagctcctcttagaggtgatcttaaagggcagcaaggagcgcagcactggggccactggagttaatgcagactcctcccgctcccatgccgtcatccaaattcagatcaaagattcagccaagaggacatttggcaggatctcttttattgacttggctggcagtgaaagagcagcagatgcaagggactcagatagacagacaaagatggaaggtgcagaaataaatcagagtctactggctctgaaggaatgtatccgagcactggatcaggaacacacccatactcccttcaggcaaagcaaactaactcaggtcctgaaggactctttcatcggcaatgccaaaacctgcatgatcgccaacatctcaccaagccacgtggccactgaacacactctcaacaccttgcgctatgctgaccgggtcaaagaactaaagaaaggcattaagtgttgcacttcagttaccagtcgaaatcggacatctggaaactcctctccaaaacgaattcagagctcccctggggctttgtcagaggacaaatgttctcccaaaaaagtcaagctgggatttcagcagtcactcacagtggcagcccctggttccacgagagggaaggtccatcctctgaccagccacccacccaacattccttttacttctgcacctaaggtctctggtaaaaggggtggctccagagggagtccttcacaagagtgggtcattcatgctagccctgtgaaaggaactgtgcgctctggacatgtggccaaaaaaaagccagaagagtcagcaccattgtgctctgagaaaaatcgaatgggcaacaaaactgtccttgggtgggaaagcagggcctcaggcccaggagaaggcctagtgcgtggtaagctgtccaccaagtgcaagaaagtgcagacagtgcagccagtacagaagcagcttgtgtctcgagttgagctctcctttggcaacgcccaccacagggctgagtacagtcaagacagccagaggggcacgcctgctaggcctgcctctgaagcttggacaaacatcccgccacatcagaaggagagggaggaacatctgcgtttctatcaccagcagttccaacagccacctctcctccaacagaagttaaaataccaaccactgaaaaggtctttacgccagtacaggcccccagagggtcagctcacgaatgagactccgcctctgttccactcttactctgaaaaccatgatggagcccaagtagaggaacttgatgacagtgatttcagtgaagattctttttcacacatctctagtcagagggccacaaagcaaaggaacaccctggagaatagcgaagactcattcttcctgcaccagacgtggggacagggtcctgagaagcaggtggcagaaagacagcagagtctgttttctagccccaggacaggtgacaagaaagatctaactaaaagctgggtggactccagggaccccataaaccacagaagagcagcactcgatcacagctgcagcccaagtaaggggcccgtggactggagcagagagaactctacttcctcagggccttctcccagagacagcctggcagagaagccatactgttcacaggtagatttcatatatagacaggaaagaggtggaggctcttcctttgatctcagaaaggatgcctcccaaagtgaggtttctggggagaatgagggcaacttgccatccccagaggaagatggtttcactatctcattgtcccacgttgcagttcctggatccccagaccaaagagacacagtcaccacacctctgagagaagtcagtgcagacggcccaatccaggtgaccagcactgtgaaaaacggtcatgctgtcccaggagaggatcctagggggcagttaggcacgcatgctgaatatgcttctggactcatgtctcccctcaccatgtccctcctggagaacccagacaacgaagggtctcctccctcggagcagctggtccaggatggggctacgcacagtctagtggcagagagcacagggggcccagttgtgagccacacagtgccatctggtgatcaagaggcagccttgccagtgtcttcagcaactaggcacctgtggctgtcctcatctccccctgataataagcctggtggtgatcttccagctctgtccccatcacccatccgtcagcacccagctgacaagctgcccagcagggaggcagacctaggagaggcctgccagagcagagagactgtacttttctcccacgaacacatgggtagtgagcagtatgatgctgatgcagaggagacggggctggatggctcctggggtttcccaggaaagcccttcaccaccatacatatgggggtaccccattctggacctacactcaccccacgaacaggaagtagtgatgtggctgaccagctctgggcccaggagagaaaacatcctacaaggcttggttggcaggagtttggtttgtccacagaccccatcaagttgccctgcaacagtgaaaatgtcacatggctcaaacccaggccgatctcaaggtgcttagcaaggccaagttctcccttggttcccagctgctctcccaagactgcagggacactccgtcagcccaccctggagcaagcgcagcaggtggtcatccgagcacaccaggaacagctggatgaaatggctgagctcggcttcaaggaggagacgctgatgagccagctggcttctaatgattttgaagattttgtgacccagctggatgaaatcatggttctgaaatccaagtgtatccagagtctgaggagccagctgcagctctatctcacctgccacgggcccaccgcagcccctgagggaacagtgccgtcttagagccagaccctgtgccgagatggtgggggccctgcaggagtctgtgctgggctctcaggctggaggagcctctgccaggtcctccctgcacacaccagaacccacacgctggtcctgcctatgctagcgtcaccccagccccacgtggcttcagataggtcccagcttctccctcagggacaggcccctgtccctcagttccatgcacaggagtgcctccaagggtgggccaggccgaagaacctaatgcctttcccttgtgcctagagaatatgattaactaaccccttgcctgtgggaatatatttgggtctaataaccctgaagtttctaagtttggggatcagaggatggggtggtcagtggtagcctagaggtcagaggtcacaagacagagaagacaacatgctgagaccagaggcttcaccagctgaattctgtgcctaacttagaagactaaacactggcccaaacttaaccattggtgctagggggacaggggtggggtgagctctgccccatcagcccttggagattgatttggggatttagaggcgtttttgaaaatgtaaatagcataaaccttgacttgatgtgtcactgacagcagcagatgtgagacaggccttatatttacagctcccttcccttcctgcaatccagtgttgaggcagaagagggtgcctgtgtcacacatcaatttttctcctgacttttgctcgggtgaaaggcctctgtacaatgcccgatactctcatgcttccatggcagctcctggctcctatctgggacacctcactacccagccccctcatggaatagtccatctcctagcctggccttcatccagttcaccctgcccagccaccctgcctctcaggggtctgtgttgggaaccttggcagttgaacagagtgctctgttcaacagtctgaggcctctgaaacagaattcacacacaaaccttcagccaagttctgcctgctgtgtatctttttagcaggaagcagctcaggacagggaagacaaagtagcctccaggtgccaattactttaaagccactctgggtcaaatggagattcatgagtcacggccttggcccgaacgcccattactatgtgagcctttatttccttcagataaaggataactttttacggttttaaaaggagggcttaattaaaaggccaagaagagggttaaatggctctcttgagacactagcagcctggtccagtcaccctttgtcagcctgacagtgcctcatctgaccgccagggggcatccttattggtgcttcccggctgcagggcactgcggcccctccctcacatgatcactaaaaaccttcaaagacccagtctagccaaaagctcaagtgggacaatggcacagtattaaggtcaaggacaaaaacttacttactttaggaatgaaccctattctatcatcatatacaacagcaccactgagagctggtgaaacagtttaaatcccatcctctgcttgtggcaaatgatgcataaatgcctgctgctcacagtaaaagggcttcttcctcttttactgggtgatccccctgaaggcccagcctatcccaactccacagtcaggaaggcctacgtccttggtccacagacggagctgggccaggtttaaaagactcagtctaggcttgcctttgcaaaccaaaaacgaggacaggtctgaagtgggaagaaagctccgaaatagaaaacggttaggtcctattctatccccagcaaatctaagcaagaaatctctttatacaccacatggcccccccactcccataaaacagccttggtaataaagaagttatcacaccaagacataccttttagatttttattagtagttctctctgaagaatcaaaatagttagttagcaaattattttagattcaagactgtatatcctttgtatttagatctttaatgatgtacaacataatacaaaacaaaccagagagactg

SEQ ID NO: 146748 - DNA, 1326 bp, Homo sapiens
  Payload ID: 9031
  Gene Symbol: KIF25
  Gene Name: kinesin family member 25
  Uniprot ID: Q9UIL4
  ENST ID: ENST00000351261
  CDS Start-End: 235-1233
ggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 146749 - DNA, 1510 bp, Homo sapiens
  Payload ID: 9031
  Gene Symbol: KIF25
  Gene Name: kinesin family member 25
  Uniprot ID: Q9UIL4
  ENST ID: ENST00000354419
  CDS Start-End: 263-1417
ttgtttacaaaaacaggcggcaggctggggttggtggggcttgtgtttaattaacgcagcacacaaagtcttatgacgtcgttttactcttttctctcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgcttagaaataaacaggtttcacgtggactc

SEQ ID NO: 146750 - DNA, 1613 bp, Homo sapiens
  Payload ID: 9031
  Gene Symbol: KIF25
  Gene Name: kinesin family member 25
  Uniprot ID: Q9UIL4
  ENST ID: ENST00000443060
  CDS Start-End: 392-1546
gggtctttcgaagtggagacaggtgctgcagatctcacggccgcgtctcaggagctggtgcccggtgcacgttcagtgggggatgctccgcagtgcaggctcgcgcccgggttgacacgcagacctcttgatcattgcaggagctgaaacgaaatatcagagttcactgtcggattcgtcctttgttgccttttgatagtgaatccgacgatccagttttgcagagcaggaaacaattctggtgaaatgtgatcgtcctggccaccctctgattgataagacatatcattttgaaagatatactggccttcccagctgacatggacctcaggtcagcttcagcgtgagaagcaggccaggcctgggtctggagccgtcctggccttcccagatgacatggacctcaggtcagcttcagcgtgagaagcaggccaggcctgggtctggagccgtcctggccttcccagatgacaaggacctcagggtttatggtccagcagagtctcagagcgcggtctttggagatgtgtgccccctactcacttctctcttggatgggtacaatgtttgtgttatggcgtatggacagacgggcagcggaaagagctataccatgctgggacgccattcggacgacggccctgttctgccgcttgacccacagagtgacttaggaattatccctagagtggctgaggagctcttcaggctcattttggaaaatacctcaagaagcccaaaggttgaagtctccatagtggaagtttacaataatgacatttttgaccttctggccaaagacagcattgcagcagtgtcgggggtcaagcgtgaggtggtgacagccaaggatggacggacagaggttgcgctgctggcctctgaggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactgcagaccaagcctgcagtgccaccctccccagggagcaaacagaggcaggaagggcaggaaggagccgcagagcttctcaaggggccttggctccacagctggttcctgggaaccccgcagggcatgcggagcaggtgcaggctcgactacagctcgtggactcggccggcagcgagtgcgttggtgtgtctggagtgaccgggttggccctgagggagatggcgtgcatcagccgcagccttgcggccctggcaggcgtcctgggggctttgttggagcaccgtggccatgccccgtaccggaacagcaggctcacccacctccttcaggactgcctcggaggcgatgcgaagttactggtgattctctgcatttctcccagccagaggcacctggcacagacgttgcagggcctgggtttcgggatccgagctcggcaagtccagcgaggccctgcccgaaagaagccgcccagctcccaaacggaggggaagaggaggccggattgaatgcattaacaagtttttctcctaaaactgtgtttcttgtccttgctttataatgcatatgtgctta

SEQ ID NO: 146751 - DNA, 440 bp, Homo sapiens
  Payload ID: 9031
  Gene Symbol: KIF25
  Gene Name: kinesin family member 25
  ENST ID: ENST00000496008
  CDS Start-End: 1-44
gaattatccctagagtggctgaggagctcttcagggcacagtgatttgcggcactggaatccctcagtcagagtctcagaatctctgctcttccaagtgagtggccccgggcaaggccgtactctccctacacctcaccttcgtcgtttgcagaaacgagaatcggagcagacacggaccgtgtcctccctcatcacatccacacacgacctggagaggggtgcactgggccagggctgggggtgagcttgggtgttcgtgactcaagttgcaaacggccctctgcccaaaatgatacaaaaccacaatgacatcagtgctgatatcagagatagtttacaggaaccctttaccctgaaaaggactactcttagattgctgaagtcaccagataagccatttcctgtcgttttaaagtaaataaaatgctactgcctgga

SEQ ID NO: 146752 - DNA, 6714 bp, Homo sapiens
  Payload ID: 9032
  Gene Symbol: KIF26A
  Gene Name: kinesin family member 26A
  ENST ID: ENST00000315264
  CDS Start-End: 379-5610
caggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggccgaagtctgctcggggaccgtggccgacgtgctccagtcggtggtcagtggggctgatggctgcattttttcctttggccacatgagcctgggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaatgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcgggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacccgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggtt

SEQ ID NO: 146753 - DNA, 5649 bp, Homo sapiens
  Payload ID: 9032
  Gene Symbol: KIF26A
  Gene Name: kinesin family member 26A
  Uniprot ID: Q9ULI4
  ENST ID: ENST00000423312
  CDS Start-End: 1-5649
atggtcggccgcggcgtccctctgtgcgctgcgcagcccgcggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggccgaagtctgctcggggaccgtggccgacgtgctccagtcggtggtcagtggggctgatggctgcattttttcctttggccacatgagcctgggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaatgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcgggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctga

SEQ ID NO: 146754 - DNA, 12113 bp, Homo sapiens
  Payload ID: 9033
  Gene Symbol: KIF26B
  Gene Name: kinesin family member 26B
  ENST ID: ENST00000366518
  CDS Start-End: 105-5288
tcctgagatggccccagatctgcaagagacatttgagagaagctatttattagcagacgtgaagaaatggattctgcacttgattatttagccatgacttatcaatgatgatggattggaaagcagtagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattct

SEQ ID NO: 146755 - DNA, 7287 bp, Homo sapiens
  Payload ID: 9033
  Gene Symbol: KIF26B
  Gene Name: kinesin family member 26B
  Uniprot ID: Q2KJY2
  ENST ID: ENST00000407071
  CDS Start-End: 441-6767
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgt

SEQ ID NO: 146756 - DNA, 12690 bp, Homo sapiens
  Payload ID: 9033
  Gene Symbol: KIF26B
  Gene Name: kinesin family member 26B
  ENST ID: ENST00000629409
  CDS Start-End: 1-5864
aggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattcta

SEQ ID NO: 146757 - DNA, 4653 bp, Homo sapiens
  Payload ID: 9034
  Gene Symbol: KIF27
  Gene Name: kinesin family member 27
  Uniprot ID: Q86VH2
  ENST ID: ENST00000297814
  CDS Start-End: 145-4350
agagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 146758 - DNA, 4400 bp, Homo sapiens
  Payload ID: 9034
  Gene Symbol: KIF27
  Gene Name: kinesin family member 27
  Uniprot ID: Q86VH2
  ENST ID: ENST00000334204
  CDS Start-End: 183-4097
gacaacaaaagacgcggacggcggctgcgcggtgtggcagagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 146759 - DNA, 1030 bp, Homo sapiens
  Payload ID: 9034
  Gene Symbol: KIF27
  Gene Name: kinesin family member 27
  Uniprot ID: Q86VH2
  ENST ID: ENST00000376347
  CDS Start-End: 36-896
ggggaatcacttgcaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggtcttgcagaagaagcaacaagatagtaagaaactggcatcactgtcaatccaaaatgagaaacgtgctaatgagctagagcagagtgtagatcacatgaaatatcaaaagatacagctacaaagaaaactacgagaagaaaatgaaaaaaggaagcaactggatgcagtaattaagcgggaccagcaaaaaatcaaagtaatattgtcatacattcctgctaagtataatatgaaatgttaaacggctcagagctaacgaatccatggtcttcattcagttggcttgtgaagtatctatccttgacctgcccttcactgctgtccttattcactttaaagctttgttcatctacgtagtaaaacctacttattgaa

SEQ ID NO: 146760 - DNA, 4493 bp, Homo sapiens
  Payload ID: 9034
  Gene Symbol: KIF27
  Gene Name: kinesin family member 27
  Uniprot ID: Q86VH2
  ENST ID: ENST00000413982
  CDS Start-End: 183-4190
gacaacaaaagacgcggacggcggctgcgcggtgtggcagagcgaagctgaggagtccagcgctcgccgacaggggcctgggctgtcccgagccggaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgattgttggggccaaggaatgccatgtggagagtgcaggtgaagtgatgagtcttttggagatggggaatgcagccagacatacaggtaccactcaaatgaatgagcactccagcagatcacatgcaatttttacaatcagcatttgtcaagttcataaaaatatggaggcagctgaagatggatcatggtattcccctcggcatattgtctcaaagttccactttgtggatttggcaggatcagaaagagtaaccaaaacggggaatactggtgaacggttcaaagaatccattcaaatcaatagtggattgctggctttaggaaatgtaataagcgctcttggggacccacgcaggaagagttcacatattccatatagggatgctaaaattacccggcttctgaaagattctctgggaggcagtgctaagactgtcatgatcacatgtgtcagcccctcctcctcgaattttgatgagtccttaaattctctcaaatatgccaacagagcacggaacattagaaacaaacccactgtaaacttcagccccgagtcagaccgtatagatgaaatggaatttgagattaaattgcttcgagaagctttgcaaagccagcaggctggtgtcagccaaactacccagatcaatcgagaagggagtcctgatacaaataggattcattctcttgaggagcaagtagctcagcttcaaggagaatgtctgggttaccagtgttgtgtagaagaagcctttaccttcctggttgacctaaaagatactgtcagactaaacgaaaagcagcaacacaaactgcaggagtggtttaacatgatccaagaggtcaggaaggctgtcctcacctcatttcgaggaatcggaggcactgcaagtctggaagaaggaccacagcatgttacagttctccagctgaagagagagcttaagaaatgccagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcagaatgaaaaaataatagaacaacaacttcttgtggatcaactgagtgaagaactaacaaaacttaacctgtcagtgacttcttcagctaaagaaaattgtggagatgggccagatgccaggatccctgaaaggagaccatatactgtaccatttgatactcatttggggcattatatttatatcccatcaagacaagattccaggaaggtccacacaagtccgcctatgtactctctggatcgaatatttgctggatttcgaacacgaagtcagatgctgttgggtcacatagaagaacaagataaggtcctccactgccaattttctgataacagtgatgatgaagaatcagaaggccaagagaaatctggaactagatgtagaagtcgttcatggattcagaagccagactctgtttgttcccttgttgaattgagtgatactcaggatgaaacacaaaagtcagatttggagaatgaagatttaaagattgattgtctccaggagagtcaagaattgaatttgcaaaaattaaagaattcagaacgcatacttactgaagctaaacaaaaaatgagagaacttacaattaacatcaagatgaaggaagatctgattaaagaattaataaaaacaggtaatgatgccaagtctgtaagcaagcagtattctttgaaagtaacaaagctagagcatgatgcagaacaggcaaaagtcgaactgattgaaacacaaaagcagctacaggagctggaaaacaaagatctttctgatgttgcaatgaaggtaaaattacagaaagagtttcgtaaaaagatggatgctgcaaagctgagagttcaggaaatacaattaaaaacaggacaggaagaaggtctaaaaccgaaagctgaggaccttgatgcatgtaacttgaaaaggagaaaaggttcgtttggaagtatagaccatctccagaaattggatgagcaaaagaaatggttagatgaagaagtagagaaagttctgaaccaacgccaagaattagaggagctggaagcagacttaaagaaacgggaggccatagtttctaagaaggaggctctgttacaggagaagagtcacctggaaaataagaaattgagatctagtcaggccttaaacacagatagtttgaaaatatcaactcgcctgaacttactggaacaagagttgtctgaaaagaatgtgcagctccagaccagtacagctgaggagaaaacaaagatttcagaacaagttgaagtcctccagaaagaaaaggatcagctccagaaacgcagacacaatgtggatgaaaaacttaaaaatggtagagtgttatcacctgaagaagaacatgttcttttccaacttgaagaagggattgaagctttggaagctgcaattgaatacaggaatgaaagtatccagaatcgccagaagtcacttagagcatcattccataacctctctcgtggtgaagcaaatgtcttggaaaagctagcttgcctgagtcctgttgagattagaactattcttttcagatatttcaataaggtggtgaatttgcgagaagctgaacggaaacaacagttatataatgaagaaatgaaaatgaaagttctggaacgggataatatggttcgtgaattagaatctgcactggaccatctaaaattgcagtgtgaccggagactgaccctccagcaaaaggaacacgaacaaaagatgcagttgctattacatcatttcaaagaacaagatggagaaggcattatggaaactttcaaaacatatgaagataaaatccagcagttggaaaaagatctttatttctataagaaaaccagccgggatcataagaagaaacttaaggaactggtaggggaagcaattcggcggcaactagcaccatcagagtatcaagaggctggagatggagtcctgaagccagaaggaggaggcatgctttcagaagaattaaaatgggcatccagacctgaaagtatgaaattaagtggaagagaaagagaaatggacagttcagcaagcagcttaagaacacagccaaatcctcaaaagctctgggaagatatcccagaattacctccaattcatagttctttagcaccccccagtgggcatatgttaggtaatgagaataaaacagaaacagatgataatcagtttacaaaatctcacagtcgactgtcatcccaaattcaggttgtgggaaatgtgggacgacttcatggtgtcacacctgtaaaactgtgtcgaaaagaattacgtcaaatttccgccttggaactatcattgcgacgttccagtcttggagttggcattggatcaatggctgctgattccatcgaagtatctaggaaaccaagggacttaaaaacttagacattgaataatagaacttttagtagatatgtaaaaagattcctttttctaacctgttaaaaactaaagctcaagttcactacctctttcctcagaataaaggaagaaggggaggaaggaatccctaattcttttatatgctatagatgtgtacatcttctatatatatttggggagttttagtttatattcccatagtaatcaaacatgttttccaatacttgataacatttaaatatttataaatacgcttaaatgtttttccaggcatatttgaagattaaaactagtaatagactaaaa

SEQ ID NO: 146761 - DNA, 983 bp, Homo sapiens
  Payload ID: 9034
  Gene Symbol: KIF27
  Gene Name: kinesin family member 27
  ENST ID: ENST00000495062
  CDS Start-End: 88-603
gaatccagatcttacataagatggaagtctctcacactagatactgaacattaaatagaaaatctatttagtaaaatctaagttgccatggaagaaataccagtaaaagttgctgtaagaattagacctctgctttgcaaagaagctcttcataatcatcaagtttgtgtgagagttattccaaacagccagcaagttatcattgggagagatagagtcttcacttttgattttgtttttggcaaaaattccactcaagatgaagtttataacacatgtataaagcccctagtgttgtcactcattgagggctataatgcaactgtttttgcctatggacaaactggatctgggaagacatacaccattggagggggccatattgcttcagttgtggagggccaaaagggtatcattcctcgagctattcaagaaatatttcaaagcatctctgaacatcctagcattgactttaatgtaaaagtatcttatatagaagtgtacaaggaagacctaagagatcttctagaattggagacatccatgaaggatcttcacatccgagaagatgaaaaaggaaacacagtgtgtgcttgctgctgatgaagtagtatttaatcagaaggaactggaggtgaaggaactgaagaatcaagtgcagatgatggtacaggaaaacaaagggcatgctgtatctttgaaagaagcgcaaaaagtgaatagactgcaggatctcattctgttgctcaggctggtgtgcactggcacaatcacagctcactgcagcctcgacctcccaggctcaagtgatcctcccgcctcagcctcatgagtagctgtgaccacaggtgcatgccaccgtgcccggctaattttctgatttttttgtggagacagggtctcactgtgttgctcaagctggtctcgaactcctgggctcagtgatcctaccacctcagcttcccaaagtgctgagattgatt

SEQ ID NO: 146762 - DNA, 2313 bp, Homo sapiens
  Payload ID: 9035
  Gene Symbol: KIF2B
  Gene Name: kinesin family member 2B
  Uniprot ID: Q8N4N8
  ENST ID: ENST00000268919
  CDS Start-End: 134-2155
ggcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagatcaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgccacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttaaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaacggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacacctgtcaacgctcactcatccaggagccatgcagtgttccagatcatcctgaagtcaggacggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggctggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaattatctaaagatcctcctgagaagcttaaaacatcttaaaatacactgatgggaaacatgctctttcttctgcctctgta

SEQ ID NO: 146763 - DNA, 2955 bp, Homo sapiens
  Payload ID: 9036
  Gene Symbol: KIF2C
  Gene Name: kinesin family member 2C
  Uniprot ID: Q99661
  ENST ID: ENST00000372217
  CDS Start-End: 352-2367
ggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 146764 - DNA, 2879 bp, Homo sapiens
  Payload ID: 9036
  Gene Symbol: KIF2C
  Gene Name: kinesin family member 2C
  Uniprot ID: Q99661
  ENST ID: ENST00000372224
  CDS Start-End: 114-2291
gcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaa

SEQ ID NO: 146765 - DNA, 908 bp, Homo sapiens
  Payload ID: 9036
  Gene Symbol: KIF2C
  Gene Name: kinesin family member 2C
  ENST ID: ENST00000455186
  CDS Start-End: 48-908
tcaggcccgcctgtttcccggtctcgctatcaagatccaacgcagtaatggtgaggagcggggtccctaggtcaaggggactcgtgagcggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttg

SEQ ID NO: 146766 - DNA, 320 bp, Homo sapiens
  Payload ID: 9036
  Gene Symbol: KIF2C
  Gene Name: kinesin family member 2C
  ENST ID: ENST00000423289
  CDS Start-End: 1-320
tgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacaggcaaggttgccattccatccccttggagcctcaagcctcgaagcctgggcggtgccacattcctctgttatccaaggaagaggaggaactgtcttcccagatgtccagctttaacgaagccatgactcagatcagg

SEQ ID NO: 146767 - DNA, 1124 bp, Homo sapiens
  Payload ID: 9036
  Gene Symbol: KIF2C
  Gene Name: kinesin family member 2C
  ENST ID: ENST00000452259
  CDS Start-End: 116-1124
acgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcct

SEQ ID NO: 146768 - DNA, 3266 bp, Homo sapiens
  Payload ID: 9037
  Gene Symbol: KIF3A
  Gene Name: kinesin family member 3A
  ENST ID: ENST00000378735
  CDS Start-End: 154-2262
cggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaagggatcaagcaggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacacttttttattttgtttttctattttaaaaataaaatattattttctgaa

SEQ ID NO: 146769 - DNA, 6325 bp, Homo sapiens
  Payload ID: 9037
  Gene Symbol: KIF3A
  Gene Name: kinesin family member 3A
  Uniprot ID: Q9Y496
  ENST ID: ENST00000378746
  CDS Start-End: 220-2319
gcgcaggcgtaattcaagggccgagagagcctgagactgggcttggggcggggcgagctcggaatgcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaaggggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacacttttttattttgtttttctattttaaaaataaaatattattttctgaatttcttctattgggtaatccagttagaccatattcctctacaaataaaaactatgttgatttcatagtaaagtaagttgtaatagagataattatttttttctgttgttagctgcttatgaaacttttattgtatttttttaaagttatgctactcctggccgggcatggtggctcacgcctgtaatcccagcactttgggaggccgaggcacgtggatcacttgatgtcaggagttcgagaccagcctggctaacatggtgaaaccctgtctccagtacaaatacaataattagctgggtgtggtggcgcacacctgtaatcccagctacttgggaggctgaggcaggagaatcacttgaacctgggaggcggaggttgcagtgagctgagatggcatcactgcactccagcctgggtgacagggtgacactccacctcaaaaaataaaaataaaataaaaataaagttatgctactcctaaaccacttaatatatgttttgtggttttcaaaattatgtaatcagccctgaaacacattggttgaaaatattttgagactttataagttagtatttattaaattaatattattttaataagttttgttaaatcctagtttaaatgacaaagctgtgtatagagtaggggtgagtgaaggtggagtactcttgaggtggcgataaaaatgtacccataaatttaaagtccattctgtaattggaatactgaatgtcctgtgtgtggtgaacattttctaggtgattagaattgcatttcactggctgcatttgtttgtggtatgtaagatagctagaaatttattacttaactctgtggggcattgtttagatactgtgaagagttgaggtaaatatgtgtcttgtaaaagctttgtgtgatcagaatattttggtaattataaaatgtttttgatgatacacatttaactctgttagtaattactctaaagaaatcttaattttaccagtttaaaaaaaacgcttctttttaaaagttcatgtttctaacctttaacaattcagttaataggaaaggagtaacttttaaatcaagctttaaaacatggaaatttaagccagtatgttagatattttttctatcccaccctaccatgataataaaaataaatctataaaaagtcaaaataaaaagccgatctataaaaagtcaattgagaagttctaaaagcaggctactatagcaggggtgtttgttttttgtttggagacggagtctggctctattacctaggctggagtgcagtgggacaatctcggctcactgtaacctctgtctcttcagcctcctgagttgctggaactacagctgtatgccatcatgctcggctaatttttgtatttttttgtagagatggggttttgccatgttgcccgggcctgtcttgaactcctagagcttaagtgatccacccgcctcaggctcccgaagtgctgggattacaggcatgattataggcctgagccaccacaccccgcctactatagcagttttttaaaaaaagcattatgttaaaactgattataccagatggacattaaatatccatctcagaaataccaaaatttgatacataagcctggcctgaatatcttttttttttttttgagacggagtcttactctgtcgcccaggctggagtgcagtggcgcgatctcggctcactgcaacctctgcctcctgggttcaagggattctcctgcctcagcctcttgagtagctgggattacaggtttgcgccaccacacccagctaatttttgtattttttttttagtagagaccgggtttcaccatgttggccaggctggtctcacctgactttgtgatccgcccgcctcagcctcccaaagtgctgggattacaggtgtgagccaccacgcctggcctcaagcctggtctgaatatctatatgcaaatatgggacactgacttcagagctattcatttagctccagtcatagcaattctgtagtttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgtttgccccatgaatagaatccatttgacaagccatttcatttcctttctggagaaagggagttgttttttttttctttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagaaaacatagatgtttctagtgcctttgaacttatactgtagtctgactaatttaatgaataacttcagtagcattactataatactgtatgctggccaaaattacaaattacagtttgttgcatcagtttcaaaagccatgctttcattgtattttatgtataaattgtatttgttcaagttgtatatattggtattgtatgtatacatgcagcatggttaaataagaataaaaatcttttacctaatgc

SEQ ID NO: 146770 - DNA, 2181 bp, Homo sapiens
  Payload ID: 9037
  Gene Symbol: KIF3A
  Gene Name: kinesin family member 3A
  ENST ID: ENST00000403231
  CDS Start-End: 1-2181
atgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaaggggcagtagcagcagcagtagttcagactccacatgttctgtcatagagaaacctctggataagttcttgcctaatcaagcaggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaa

SEQ ID NO: 146771 - DNA, 658 bp, Homo sapiens
  Payload ID: 9037
  Gene Symbol: KIF3A
  Gene Name: kinesin family member 3A
  ENST ID: ENST00000428744
  CDS Start-End: 152-658
ttagcttatgatgcagaatgaaacccgtaggtgtctttgtgtgtgtggcggtgttatgtttatcttccaggatttcacagattgttatcgtgaacttaataatggggccttctaagaccccttattaggggtcatggaggaaaattgagccatgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagag

SEQ ID NO: 146772 - DNA, 738 bp, Homo sapiens
  Payload ID: 9037
  Gene Symbol: KIF3A
  Gene Name: kinesin family member 3A
  ENST ID: ENST00000450441
  CDS Start-End: 1-558
tctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacat

SEQ ID NO: 146773 - DNA, 3333 bp, Homo sapiens
  Payload ID: 9037
  Gene Symbol: KIF3A
  Gene Name: kinesin family member 3A
  ENST ID: ENST00000618515
  CDS Start-End: 154-2331
cggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaagaagaaatatcaggctctgatatcagtgggtcagaggaagatgatgatgaagagggtgaggttggagaagatggagagaaaaggaaaaaaagaaggggtaatagcagcagcagtagttcagactccacatgttctgtcatagagaaacctctggataagttcttgcctaatcaagcaggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacacttttttattttgtttttctattttaaaaataaaatattattttctg

SEQ ID NO: 146774 - DNA, 6103 bp, Homo sapiens
  Payload ID: 9038
  Gene Symbol: KIF3B
  Gene Name: kinesin family member 3B
  Uniprot ID: O15066
  ENST ID: ENST00000375712
  CDS Start-End: 168-2411
atccggggcagcggggaatggctgagccaggggttcgccgcccccgccgccgccgccgccgccgccgccgccgccgccgcccgctttcggctcgggcctcaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggccatggagagtaagttgcttgttggaggaaaaaatatagtagatcatacgaatgaacagcagaaaatcctggagcagaaacgacaggaaattgcagagcagaaacgtcgagaaagagaaatccagcaacagatggaaagtcgagatgaggagaccttggaacttaaagagacatacagctcattgcagcaagaggtggacatcaagaccaaaaaactcaaaaagctcttctccaagcttcaggcagtgaaggctgagatccatgacctccaagaagaacacatcaaggagcgccaagagctagagcagactcagaatgagctcaccagggagctgaaactcaagcatcttattatagaaaactttatccctctggaagaaaaaagtaaaattatgaatagagccttctttgatgaagaggaagatcattggaaactacatcctataaccagactggagaaccagcagatgatgaagcggccagtctcagccgtgggatataagagaccattgagccagcacgcaagaatgtccatgatgattcgtccagaggcccgatatagggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaa

SEQ ID NO: 146775 - DNA, 5344 bp, Homo sapiens
  Payload ID: 9039
  Gene Symbol: KIF3C
  Gene Name: kinesin family member 3C
  Uniprot ID: O14782
  ENST ID: ENST00000264712
  CDS Start-End: 581-2962
gtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctcctgcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtcataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccgaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagttgacaataaaggaatgagtatcgtcacggagt

SEQ ID NO: 146776 - DNA, 3180 bp, Homo sapiens
  Payload ID: 9039
  Gene Symbol: KIF3C
  Gene Name: kinesin family member 3C
  Uniprot ID: O14782
  ENST ID: ENST00000405914
  CDS Start-End: 574-2955
ggcggtggctgcgctgcacccgactggtgggcgcaggacctgggtcggcaccggagcctgtcatcccggagcggtcggcgggggtgcagagacggcgatgcgcccctgtcccccgcacccgggccgctccgggctcgcgcctcccgccccgcggccccgccccctgccccaccccagtcgggaggcttagctggggccgcagcgcggcggcaacatcactctcgctgccgctgctccgccccatccccttctgtttttctctctcattctccagtggcggcggcggggaaggcggaggcagaggcagcagcagccgcgctggctgcaatgaatgatcccccagcttggggggaggactccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccc

SEQ ID NO: 146777 - DNA, 5452 bp, Homo sapiens
  Payload ID: 9039
  Gene Symbol: KIF3C
  Gene Name: kinesin family member 3C
  ENST ID: ENST00000417737
  CDS Start-End: 581-2638
gtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctcctgcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtactcactctgtcgcccaggctgaaatgcagtggcacgatctcagctcactgaaacctccatctcccaggttcaagcaattctctgagtaacctcctcagtagctggggttacagcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtcataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccgaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagttgacaataaaggaatgagtatcgtca

SEQ ID NO: 146778 - DNA, 5462 bp, Homo sapiens
  Payload ID: 9039
  Gene Symbol: KIF3C
  Gene Name: kinesin family member 3C
  ENST ID: ENST00000455394
  CDS Start-End: 581-2599
gtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctcctgcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtatattttatgtaaatggaatcacacaatatgtagtccgttgcgactgagttcttccacttagcaaaatgttttcaaggttcgtccatgttggaacactcatcagtacttcattcctttgtattgcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtcataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccgaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagttgacaataaaggaatgagtatcgtca

SEQ ID NO: 146779 - DNA, 3719 bp, Homo sapiens
  Payload ID: 9039
  Gene Symbol: KIF3C
  Gene Name: kinesin family member 3C
  ENST ID: ENST00000614152
  CDS Start-End: 154-2532
cctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaacgtgagcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacagcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgaaaatagatcctttattcactagttacgcaaattggttcctagggggatactccttaccttcctttgtgatggcccaaaatgtctctaggtatctcaagtgataagtaaatttct

SEQ ID NO: 146780 - DNA, 4348 bp, Homo sapiens
  Payload ID: 9040
  Gene Symbol: KIF4A
  Gene Name: kinesin family member 4A
  Uniprot ID: O95239
  ENST ID: ENST00000374403
  CDS Start-End: 83-3781
gctccggctgggacagggcggcgggaggcccagggagaacggggaagggacatttagtttgagacggtgctgagataggatcatgaaggaagaggtgaagggaattcccgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgttt

SEQ ID NO: 146781 - DNA, 4378 bp, Homo sapiens
  Payload ID: 9041
  Gene Symbol: KIF4B
  Gene Name: kinesin family member 4B
  Uniprot ID: Q2VIQ3
  ENST ID: ENST00000435029
  CDS Start-End: 106-3810
ggatttgaaacttggcggttaaagctccggctgggacagggcggcgggagaccccgggtgaacggggaagggacatttagtttgagacggtgctgagataggatcatgaaggaagaggtgaagggaattcctgtaagagtggcactgcgttgtcgccctctggtccccaaagagattagcgagggctgccagatgtgcctttccttcgtgcccggggagactcaggtggtggttggtactgataaatccttcacctacgattttgtgtttgacccctgtactgagcaggaagaagtcttcaataaagcagtagcgccgctcataaaaggcatatttaaaggatataatgcaacggtcctggcctatgggcagactggctctggaaaaacctattcaatgggaggtgcatacactgcggagcaggagaatgaaccaacagttggcattattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgggaggatcctaaggaaggcataaagattgtgggactcactgagaagactgttttagttgccttggatactgtttcctgtttggagcagggcaacaactctaggactgtggcctccacagctatgaactcccagtcgtcccgatctcatgccatctttacaatctccatagagcaaagaaagaaaagtgacaagaattgcagctttcgctccaagctgcatcttgtagatctcgctggatcagaaagacagaagaaaaccaaggctgaaggggatcgtctaaaagagggtattaatattaaccgaggcctcctatgcttgggaaatgtaatcagtgctcttggagatgacaaaaagggtagctttgtgccctacagagattccaagttaactcgactgctgcaagattctctaggaggtaacagccacactcttatgatagcctgtgtgagtcctgctgactccaatctagaggaaacattaagtacccttcgctatgctgacagagcaagaaaaatcaagaacaaacctattgttaatattgatccccacacagctgaacttaatcatctaaagcaacaggtacaacagctacaagtcttgttgctacaagcccatggaggtaccctgcctggatctataaatgcagaaccatcagagaatctacaatccctgatggagaagaatcagtccctggtagaggagaatgaaaaattaagtcgttgtctgagcaaggcagctggtcagacagcccagatgttggagaggatcattttgacagagcaagtgaatgaaaaactgaacgccaagctagaagagctcaggcagcatgtggcctgcaagctggatcttcaaaagctagtggagactttggaagaccaggaattgaaagaaaatgtagagataatttgtaacctgcagcaactgattacccagttatcagatgaaactgttgcttgcacggctgcagccattgatactgcggtagaagaagaagctcaagtggaaaccagtccagagacaagcaggtcttctgacgcttttaccactcagcatgctctccatcaagctcagatgtctaaggaggtggttgagttgaataacgcccttgcactgaaagaggccctagttaggaagatgactcagaacgacaaccaactacagcccattcagtttcaataccaggataacataaaaaatctagaattagaagtcatcaatctgcaaaaggaaaaggaagaattggttcgtgaacttcagacagcaaagaagaatgtcaaccaagccaagctgagtgagcaccgccacaaacttctccaggagctggagggtcaaatagctgatctgaagaagaaactgaatgagcagtccaaacttctgaaactaaaggaatccacagagcgtactgtctccaagctgaaccaagagatatggatgatgaaaaaccagcgggtacagttaatgcgtcaaatgaaagaggatgctgagaagtttagacaatggaagcagaaaaaagacaaagaagtaatacagttgaaagaacgagaccgtaagaggcaatatgagctgctcaaacttgaaagaaacttccagaaacaatccagtgtgctcagacgtaaaacggaagaggcagcagctgccaacaagcgactcaaggatgctctccagaaacaacgagaggtcacagataagcggaaagagactcagagccatggaaaggaaggtattgcagctcgagtgaggaattggcttggaaatgaaattgaggttatggtcagtactgaggaagccaaacgccatctgaatgacctccttgaagacagaaagatcctggctcaggatgtggttcaactcaaagaaaaaaaggaatctcgggagaatccacctcctaaactccggaagtgtacattctccctttctgaggtgcatggtcaagttttggagtcagaagattgtattacaaaacagattgaaagcctagagactgaaatggaactcaggagtgctcagattgctgacctacagcagaagctgctggatgcagaaagtgaagataggccaaaacaatgctgggagaatattgccaccattctggaagccaagtgtgccctgaaatatttgattggagagctggtctcctccaaaatacatgtcaccaaacttgaaaacagcctgagacagagcaaggccagctgtgctgacatgcagaagatgctatttgaggaacaaaatcatttttctgagatagagacagagttacaagctgagctggtcagaatggagcaacagcaccaagagaaggtgctataccttgtcagccagctgcaggaaagccaaatggcagagaagcagttagagaaatcagccagtgaaaaggaacaacagctggtgagcacactgcagtgtcaggatgaagaacttgagaagatgcgagaagtgtgtgagcaaaatcagcagcttctccaagagaatgaaatcatcaagcagaaactgatcctcctccaggtagccagcagacagaaacatcttcctaatgatacccttctatctccagactcttcttttgaatatatcccacctaagccaaaaccttctcgtgttaaagaaaagtttctggagcaaagcatggacatcgaggatctaaaatattgttcagagcattctgtgaatgagcatgaagatggtgatggtgatggcgacagtgatgagggggatgatgaggaatggaagccaacaaaattagtcaaggtgtccaggaagaacatccaagggtgttcctgcaagggctggtgtgggaacaagcagtgtgggtgcaggaagcaaaagtcagactgtggtgtggactgtagctgtgaccccacaaagtgtcggaaccgccagcaaggcaaggatagcttgggcactgttgaacagacccaggattccgaaggctccttcaaactggaggatcctaccgaggtgaccccaggattgagcttctttaaccctgtctgtgccacccccaatagcaagatcctgaaagagatgtgtgacatggagcaggtgctgtcaaagaagactgctccagctccctccccttttgacctcccagagtcgaaacatggagcaacagaataccaacaaaataagcctccagggaagaaaaagaaacgagctctggctagcaacaccagcttcttctctggctgctcccctatcgaagaagaggcccactgaagttggagtcatcatctctacccccaatctggcttgggagatgctttccagttgcagccagaaggggttttttaaatgacttctctggatttcaggtttcttgccgttgaaaaaaaggaacaaagcattactaaaaagaaggtaacctttgttggatgttgtccctcagtctccatccccagactactgctctctgctctctagaaggctgctaaaccacctgctgaagagagaaccaacagactttcctaatgactcatcaggaaccagtcctcagtatgatcaagttccttcttatttgtgagcagttcaggctatctcctgatggggatgaggccaaggctttcttatcttttggttgtctctgcttaatggaggagcctggcctaggatggaggtctggctcagatctttcactccacctcgggaatggggttgtgatctttcctgtcctgaccccctctgaattgtaagtgtttcaatagtactcttgattgtatgccatgttgttgaagtaaatgaattatttttaaatgttaagtaaataaaccttagcccatctactgtt

SEQ ID NO: 146782 - DNA, 3527 bp, Homo sapiens
  Payload ID: 9042
  Gene Symbol: KIF5A
  Gene Name: kinesin family member 5A
  ENST ID: ENST00000286452
  CDS Start-End: 229-3060
agagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaag

SEQ ID NO: 146783 - DNA, 5824 bp, Homo sapiens
  Payload ID: 9042
  Gene Symbol: KIF5A
  Gene Name: kinesin family member 5A
  Uniprot ID: Q12840
  ENST ID: ENST00000455537
  CDS Start-End: 275-3373
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccctgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgcatttttttttttttttttttttggtggaagaagtctcagcgtctcttaggactgactgttcaaaggctcctcagcaaatgagcccttgaacagtcctaagagaccctgaggattctgtggagtagtttgaaaaccattgttctgaggaagggggtccaatctggctcctctgcactaaagctgcaactcatggaaaagagggcaacggtggggtagacaagccatgctgtctccagacccactagggtggaaggaaggttcctgtgggcctgtggacttaggctaatatttgctgtcagcagggcacttaagaatccagggggttttatgtaatgttgccaccacatggttcttttaaaaacacataaggaaatgtgagggtgtagcgcagatgaggagagagatgacacagagggagcagccttctctttagcaagatgtaagggaaatataattcacttacataaaaaagaaacaacacacacgcaaacccttcaccagaagcttcacactacatcctcctcctcctcctgctccccaccttcaccgcatccctttcagagccagggtcactgcaaggggcacctggcctgcccactcacatctgccaaaatgttgcatgccagcgtggaagacaaaccaaactgcgcaaccccctgtgtgtatttacttggtgtacatagataactttaaaataaaataaattcaatgataactct

SEQ ID NO: 146784 - DNA, 5877 bp, Homo sapiens
  Payload ID: 9043
  Gene Symbol: KIF5B
  Gene Name: kinesin family member 5B
  Uniprot ID: P33176
  ENST ID: ENST00000302418
  CDS Start-End: 459-3350
cgccctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaa

SEQ ID NO: 146785 - DNA, 505 bp, Homo sapiens
  Payload ID: 9044
  Gene Symbol: KIF5C
  Gene Name: kinesin family member 5C
  ENST ID: ENST00000450621
  CDS Start-End: 278-505
gacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgtt

SEQ ID NO: 146786 - DNA, 6931 bp, Homo sapiens
  Payload ID: 9044
  Gene Symbol: KIF5C
  Gene Name: kinesin family member 5C
  Uniprot ID: O60282
  ENST ID: ENST00000435030
  CDS Start-End: 369-3242
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 146787 - DNA, 3632 bp, Homo sapiens
  Payload ID: 9044
  Gene Symbol: KIF5C
  Gene Name: kinesin family member 5C
  ENST ID: ENST00000616530
  CDS Start-End: 1-2583
gggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatat

SEQ ID NO: 146788 - DNA, 1330 bp, Homo sapiens
  Payload ID: 9045
  Gene Symbol: KIF6
  Gene Name: kinesin family member 6
  Uniprot ID: Q6ZMV9
  ENST ID: ENST00000229913
  CDS Start-End: 155-952
ctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacacca

SEQ ID NO: 146789 - DNA, 9082 bp, Homo sapiens
  Payload ID: 9045
  Gene Symbol: KIF6
  Gene Name: kinesin family member 6
  Uniprot ID: Q6ZMV9
  ENST ID: ENST00000287152
  CDS Start-End: 96-2540
gttgctaagactgtgggtcgccggaggtggtgggagttagttttggcagcccgggcctgagagaggtcaagggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 146790 - DNA, 2394 bp, Homo sapiens
  Payload ID: 9045
  Gene Symbol: KIF6
  Gene Name: kinesin family member 6
  ENST ID: ENST00000394362
  CDS Start-End: 216-962
acagtcctgaggggtgcagcgggtggcactggaagggcctcctcagcaggttgtcagccagctggaagagcctggggccacctgtctggtcagagtctctctgctgtgggcctcttggagccagggctggttttgtggtctgactgaagtgacaatgaaattaataggatcctgatgctgtgactgaggccatttccctgtgtctccaaacaggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagg

SEQ ID NO: 146791 - DNA, 743 bp, Homo sapiens
  Payload ID: 9045
  Gene Symbol: KIF6
  Gene Name: kinesin family member 6
  ENST ID: ENST00000441975
  CDS Start-End: 1-486
actcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattaaaagcaccaagctcctctgatggagttctcttctgcagaaaccaatgagtgaggcaggatctgtttcagcaaaggccctggtcaggtatcagcatcacacagtgttcctgctggagagaggagacagcatgcaaagtcaagattcaggtggaactgaactgctagggtggattttgttgctgtccctacccttccagaagccctatagcattacagtgctgaatgagaaagagagttaacaaagttattagccccaagacaaaaactagttcagaatttaaggaaaataaacatattagacattg

SEQ ID NO: 146792 - DNA, 8611 bp, Homo sapiens
  Payload ID: 9045
  Gene Symbol: KIF6
  Gene Name: kinesin family member 6
  ENST ID: ENST00000458470
  CDS Start-End: 1-2069
ggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaagaaaagaagaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatgtttgggaagcaattgaatttccaggaaatatccatccatgaattatgccagcaagaatgaagcacagatgaaggcagcgcccctcacttgctctggcttcagaagtgaactatgggctgctgggagcaactagtgactttgattcccatggaggggactgtgtttctttaaggatgctgacctggaggccaccgagaggctggggctggggctgaccacaacatccttcctgtggttgctggagctgctggcagggccaggcaaggccagagtgctaggggcagggtgaaggcttcagctcactgttgtagtgacgttttgtgtagatctttataagcttttgagaatgtgaaatagcaccatcaaaatataatgtcagaggatgctcacaccagtggaatgtggggggaatatttttatttttaacgatttgccagctctctcccttggcccgtgctctggtttggaagcccagaaatggccatgacaggtccaggcaggatgtcccagccacaggcaaggcagtggaatgcagggcatcctgaaggccaatcctgatctcccagaccacatctttcaccatcagcctcttggccaggatgacctggaggcagtgcctgaacagctgtgtctccagggagccatctgccctgcagggtctaaggacatcatagcacccagagaacagtgggcagctcccaggggctctgctgagagcttgagagagggcagtgtgggtaccttgggcctcacaaccttcacccagccacttgggaggatttgggctgacactccccacttccacagggaaaaacatagctgcctgggggtcttgtctccatgggccctctccatgacagatccaagggaaggtgggcagccctcaaggaggttcttgaagaactgccccctgggccagggggttccaacccagctgcagccagggaggggcagcggagggtgagcaggagtggcacctggaaatgaagctaactggataaaagtgctggtccactgctcctggtgtctctgtcctataaatacaggacctgatgaccctggaggggagcagagtggtaatatagtataattggcttgattttctttttcgttttttaggactgggtaacaggatcatgcaggagaagattaaaccattacatttctaagctaggcaggcccatcgagctcctctaatccacacccctattttatataattagaaggccagagtgaaggggagattcagcttgctgttctatgccactgacaaatgtcccctcttcagggggcttcccctgaccactccatctcgagtcaccccctagttatcccctatcccattaccattttttctgcatcactatctgacatgttatccttccgaacttgcctatttttgaaatacctgcaaccccccataatactaagagctccaatgcaacagggacctgtttgtcttgctcattgctgtgtcccaagcacagagtcgctgttcagtaaacggtccttcagttcatgagtagacgagccagaacccagatgtgtttctcaggctggtgtcactctgacttcccccaggctctgactgaatcccatcgggacaggggccagcatctctggtccactcctggccctcacagttcaatggaacatagtaagccctctgtaaagtctgtagaaccagaggaagaccaaattctgattctagaagcctccccaagagtccatggaacacacatgtaactgcacacacacacacacatacacacacacactctcaagagccctgaagatggcatggcatttgccccagtcccctatgtagcagcagcagtattcttggcatgccttagtgccctcagccctctagagctgggtagagtctactaacttttattttcttttatttttactttcttttatttattttttgagatggggggggtctctgtcagccaggctggggtgcagtggtgcgaccatacctcactagtcagcctccaactcctgggctcaagccatactcagcctccaactcctgggctcaagcgatcctctcacctcagcctccaaagtagctggaactacaggcatgcaccaccacacctagctcgttttaaattttttgtagagacagggtctcactgtgtggctcaggatggtctcaaattcctggccttaagcgatgctcccgccttggcctcccaaagtgctgggattgcaggcatgagccacataccctgccagagtctttcaacattagatctcccactgagacatcatctcctggatccaaaggccttactgacagagatgtgtggcatggccccatgcggggtgtgaaccagcctcctggggcaatcactaagacaggaaaggaaatgaagacagaaaaacacacaacatgggatctggggccactggtgtccagagcatatgcaaagtgtgtgcagcaactggccaaggggccttttgctccgaacatcccctaatggaagcccagcctttgatatggacacatgcttgacagcagtgcaccttcccagagttcactggcctctgcaaatgggagaaattgatgcaatgttttgaaaagactttccagcaatccacctgggatcagtggagccacggatgacaagaagtatctgagttcactctaggccaaaatgtgggattttcaaaaacattttctggaaagcagcctagccagtgactccagcccagtccctgctagaattcaactggctctaccaatcccttgacaagaagtagggtggacggaggttggaggagggaagttaaaatgtagcttgcccagatcttgctaaaaaggagttttagaaagcagatagagaaattgtggtatactgaatacatcattttaattcttcaccaccagtatagaattacacatccaaagctttgtcatggcccactttgactaatgtggtgttggcaaacctgatccaggcagaggcttgaattgtgctctcatggttgagcttgcctcttgctccagtgatctctcttgggatgaacatgccatgggtagctgctgccccttcagcctggaacatccagagagcagacctgagcccagtctacagcctggagcagagcctcccaggcaagcccagcccagatcagctgaactatggctcacccaaagacctattggcatgagaatatatgctgcttgtcataaaccactgaggtttagagtggtttgttatatagcattaattgtagcaatagcagactggcacagaaattggaacccagagacagtatatgactggatctaggatttctcagtgcagagttcattgtctctccatgcagcctgtggaaaggcactgagagcatcctgtatatggaaaagcaggaccaccacctacagccatgatgaagcaacaaggacctgatttaccctcctgctttaaatgactaaaaatgagacaaaatcctctatacaaaccaatggttttcagccattggataacaagcaatatagggtatgattgatccgcaagagaagggaaacaagtgaggggagccctatgattgctccaacttactgcctgcagtgagttttcaggctgcagcccaggaagggggaaccaggtagagcccagtggtttccctgagttgaggaaatggagctgggaatccagggaggacaaagtggcttaaatttgcaaggcagagtcccagggatgagagagagagaaggagagagagaggagaaaaaagagagagaaagagagagagcatgctctggagatcttcagagggttacccttgagtcttcagctaactaccgatcaacatctgcatgtgaagaaattacccaaggcaggggaaagaaccaccaggaggaagcaggtggaataatttcctgagataacactgtgttgggaagagttcatgtttccaacagccagagtggagaaacctcccaaaacagtcattgtatagagacacataaggtactgcctcagaagtggggccaaattagtcctagatgatagattgctctggtcccacctaacaaagcttaaaaagccagccccaaaggagtcaaattgtttccagtaagtttccaagtaacttcaatgagtcccaaaacaaagcttcaaaatatctaaaggaatatgaaaaacaaaccaaaaagaaaccagcatccaacaatatagaatccacaatgtctggtgtccattaaaaaataatcaggcatgcaaagaagcaggaaaatatgggccatgagaggagaaaaaaccatcaatagaaatagaggccgggtgtggtggctcactcctataatcccagcactttgggaggccgaggcaggaggatcacctgaggtcaggagttcaagaacagcctgttcaacatggggaaaccccgtctctactaaaaatacaaaaaatagccgggcatggtgttgcgtacctgtaatcccagctactcagaggctgaggcaggagaattgcttgagcccaggaggcagaggttacagtgagccgaaattgtgccattgcactccagcttgggcaacaagagtgaaactctgtctcaaaaaaaaaaaaaagaaaaaacaaatagaaacagccccaggcatggcacagttgatagagtaaatagacagaaacattttttaaaatgcaatgggtgtgtgtttcaaatctaggcagaaaaaatgctccttgtaattccttaaacataagcatgtctcattcatctggtcattgttttgacaaggatgtgccatccattgtgctaagttctgaggagtcagaggtgacagagacagagaaagtgccagcattcttggaaccttctaacgaaggagagggacaagccaggcatggtggctcacgcctgtaatcccaacactttgggagactgaggctggcggatcacgaggtcaggagtttgagaccaacctggccaacatggcgaaaccccatcgctactaaaaatacaaaaattagctgggtgtggtggtgcgcacctgtaatcccagctactctggaggctgaggcaggacaatcacttgaaccctggaggcagagtttgcagtgagctgagatcgtgccactgcactccaacctgggcaacaagagcgagactccttctctgaaaaaaaaaaaaagagagggacaataaacaagtaagcaagacaatctgattaagaaggagttggggttagctgggcatggtagcaagcgcctgtagtctcagctactcgggaggctgaggtgggaggatccttgaacccaggaggttaaggctgcagtgagctgtgatcacaccactgcactccagcctggatgacagagcaagaccctgtctcagaaaaagaagaaggagttgggggtggggtaggatgggcttggactcactatcaaggtgggtgggagtgtgagaacccggcaaggtgcaaagagagaagcagggaagggaagcttaggacaatgatggcaggttgggtattgggtgatgggaagaggcaaaggacgtggagcttggcaaaaaggggacttgtggggatttgggccatgtgagcatgtgggggagacagtgttccttccataacacgtgtccagggactgccagggctccgaggcagagcaggtgtagagaggttggctgtgaatgttggatgttgaaaacatatgtgtcaaatgtgggaggaaaaagcagtgtttccttgaatacaagctcctcctcaccttgcgaaaagtggcctctgagtgtagccctgaatgcatctcccaaggaataggaggaagcagcaaccttttcagagttaactgctttatttgggttttccatggcctcgtgccagccagcagggctgagccagtttcacccacactgagagggaactcagcaaagagcaagcagcatgccagctggtactcttccctctccattcactcagctcctgatctcaggagggcagcccctccccaggccagcacccctccccttctggccccaggtgtgggatgttgttgttttcttttctccgaaacatctcctgggtttgtcttttccatcactgtctttagactgaggcaagcagtccccatgccttcagccccatgttttgggggtaacctgtgctttgacatgctttgctaaaaactttctaagtctccctctggtgctgggaccagccatgaccaacaacgtcatccatgcaggccacccctaacatagtccaggcctcatgtgggtctcagttcccttttcttctttcaggaagttctccagtgcatgcatagggttgaccagatgtcccaaggtgctctaggacttatgcctatgaagctgttttagggcttcctagtcagtccctggttccaggaaagcagcctgatgaggagatcattcccgctggctggtgtggcatttcttttatggcactacctgggattgggccaccagacctgcgctaacatgctgatttgatggactcttaacatcataggacaaagaatcgtcatgtgaaccaattagacaataaacaaatgcctaagtgcc

SEQ ID NO: 146793 - DNA, 2386 bp, Homo sapiens
  Payload ID: 9045
  Gene Symbol: KIF6
  Gene Name: kinesin family member 6
  ENST ID: ENST00000538893
  CDS Start-End: 1505-2386
gggtcattgcagagccagggaggagatggtgaagcagactatccagatattcgcgagggtgaagccccctgtccggaagcaccaacaagggatttattccatagatgaagatgaaaaattaatacctagcttggaaatcatcttaccacgtgatttggcagatgggtttgtgaataataagcgagaaagctacaaatttaaatttcaaagaatttttgatcaggatgcaaaccaagagaccgtttttgaaaacattgccaaaccagttgctgggagtgtcctggcaggttacaatggtaccatctttgcatatgggcaaacaggcagcgggaagacattcactatcacagggggtgcagagcgttacagtgacagaggcattatcccaaggacactgtcatacatttttgaacagttacaaaaggacagcagcaaaatatatacaacacacatttcctatttggaaatctacaatgaatgtggttatgatcttttggatccaagacatgaagcctccagtttggaagatttgccgaaagtgacaatactggaggatcctgatcagaacattcacctgaaaaacttgactctccatcaggcaaccacagaggaagaagctctgaatttgctttttttaggagacaccaaccgaatgattgcagagactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcagtatcctttctgaagtgatgaagaaacttcctctatcctggtttgaaaggggaatgagagaggaaatgtcattaggatgccaggaggcttttgaaatcttcaagagggaccacgctgacagcgttaccatcgatgacaacaaacagattctgaaacagagattttctgaagccaaggccctgggagaaagtataaatgaagcaagaagtaaaattggtcacctgaaggaagaaatcacccagcggcatatacagcaagtagccctaggaatctcggaaaacatggccgtgcctctgatgccagaccagcaggaggagaagctgcgatcacaactggaggaagaaaagagaaggtataaaacaatgttcactcgcctgaaagccctgaaggtggagatcgagcacttgcagctgctcatggacaaagccaaggtgaagctacagaaagagtttgaagtctggtgggcagaggaggccaccaacctgcaggtaaattctccagcagtgaattcactcgatcacacgaagccatttctccagacatctgactcccagcatgaatggtcccaactcctctctaacaaaagttctggaggctgggaagtccaagatcaaggcactggcagattcgatgtctgtgatgtgaatgccaggaaaatcctgccctcgccttgccccagtccacacagccagaaacagagcagcaccagcaccccactggaagacagcatccccaagaggccagtgtcgtccatccctctcaccggagacagccagacggactcggacatcatcgccttcatcaaggccagacagagcattctgcagaagcaatatcttcagctcctttgttctctgttcccaaagtcagctgtctcctctgctcaggcttctacaaacaggaaggggctgagtgatgttttggtaactcgttga

SEQ ID NO: 146794 - DNA, 4551 bp, Homo sapiens
  Payload ID: 9046
  Gene Symbol: KIF7
  Gene Name: kinesin family member 7
  Uniprot ID: Q2M1P5
  ENST ID: ENST00000394412
  CDS Start-End: 78-4109
ctggggatggaaacctgactgcctggcccgggacggcgcttgcagccaggcagggcccagagcagtcctccctcggcatggggctggaggctcagaggctgccaggggctgaggaggccccagtgcgggttgccctgcgagttcgaccactgctgcccaaggagctgctgcacgggcatcagagctgcctgcaggtggagccagggcttggccgcgtcactctgggccgtgaccgacactttggcttccacgtggtgctggccgaggatgcggggcaggaggccgtgtaccaggcctgcgttcagcccctccttgaggccttcttcgagggcttcaatgccactgtctttgcctatggtcagacgggctcagggaagacatacaccatgggggaggccagtgtggcctccctccttgaggatgagcagggcattgtcccgagggccatggccgaggccttcaagctcatcgatgagaacgacctgcttgactgtctggtacatgtgtcctacctggaagtgtacaaggaggagttccgagacctgctcgaggtgggcactgccagccgtgacatccagctccgggaagatgagcgcgggaatgttgtgctgtgcggggtgaaggaggtcgacgtggagggcctggatgaggtgctgagcctcctggagatgggcaacgcggcgcggcacacgggagccacgcacctcaaccacctgtctagccgctcacacacggtcttcaccgtgaccctggagcagcgggggcgcgcccccagccgcctaccccgccccgccccgggccagctgctcgtctccaagttccacttcgtggacctggcgggctcagagagggtgctcaagacgggcagcaccggcgagcggctcaaggagagcatccagatcaacagcagcctcctggcgctgggcaacgtcatcagcgccctgggggaccctcagcgccggggcagccacataccctaccgcgactccaagatcacccggatcctcaaagactcgctgggcgggaacgccaagacggtgatgatcgcctgcgtcagcccttcctcctccgacttcgacgagaccctcaacaccctcaactacgccagccgcgcccagaacatccgcaaccgcgccacggtcaactggcggcccgaggccgagcggccacccgaagagacggcgagcggcgcgcggggtccgccacggcaccgctccgagacccgcatcatccaccgcggccggcgcgccccaggcccagccaccgcctccgcggcggccgccatgcgcctgggcgccgagtgcgcgcgctaccgggcctgcaccgacgccgcctacagcctcttgcgcgagctgcaggccgagcccgggctgcccggcgccgccgcccgcaaggtgcgcgactggctgtgcgccgtcgagggcgagcgcagcgccctgagctccgcctccgggcccgatagcggcatcgagagcgcctccgtcgaggaccaggcggcgcagggggccggcgggcgaaaggaggatgagggggcgcagcagctgctgaccctgcagaaccaggtggcgcggctggaggaggagaaccgagactttctggctgcgctggaggacgccatggagcagtacaaactgcagagcgaccggctgcgtgagcagcaggaggagatggtggaactgcggctgcggttagagctggtgcggccaggctgggggggcccgcggctcctgaatggcctgcctcccgggtcctttgtgcctcgacctcatacagcccccctggggggtgcccacgcccatgtgctgggcatggtgccgcctgcctgcctccctggagatgaagttggctctgagcagaggggagagcaggtgacaaatggcagggaggctggagctgagttgctgactgaggtgaacaggctgggaagtggctcttcagctgcttcagaggaggaagaggaggaggaggagccgcccaggcggaccttacacctgcgcagaaataggatcagcaactgcagtcagagggcgggggcacgcccagggagtctgccagagaggaagggcccagagctttgccttgaggagttggatgcagccattccagggtccagagcagttggtgggagcaaggcccgagttcaggcccgccaggtcccccctgccacagcctcagagtggcggctggcccaggcccagcagaagatccgggagctggctatcaacatccgcatgaaggaggagcttattggcgagctggtccgcacaggaaaggcagctcaggccctgaaccgccagcacagccagcgtatccgggagctggagcaggaggcagagcaggtgcgggccgagctgagtgaaggccagaggcagctgcgggagctcgagggcaaggagctccaggatgctggcgagcggtctcggctccaggagttccgcaggagggtcgctgcggcccagagccaggtgcaggtgctgaaggagaagaagcaggctacggagcggctggtgtcactgtcggcccagagtgagaagcgactgcaggagctcgagcggaacgtgcagctcatgcggcagcagcagggacagctgcagaggcggcttcgcgaggagacggagcagaagcggcgcctggaggcagaaatgagcaagcggcagcaccgcgtcaaggagctggagctgaagcatgagcaacagcagaagatcctgaagattaagacggaagagatcgcggcattccagaggaagaggcgcagtggcagcaacggctctgtggtcagcctggaacagcagcagaagattgaggagcagaagaagtggctggaccaggagatggagaaggtgctacagcagcggcgggcgctggaggagctgggggaggagctccacaagcgggaggccatcctggccaagaaggaggccctgatgcaggagaagacggggctggagagcaagcgcctgagatccagccaggccctcaacgaggacatcgtgcgagtgtccagccggctggagcacctggagaaggagctgtccgagaagagcgggcagctgcggcagggcagcgcccagagccagcagcagatccgcggggagatcgacagcctgcgccaggagaaggactcgctgctcaagcagcgcctggagatcgacggcaagctgaggcaggggagtctgctgtcccccgaggaggagcggacgctgttccagttggatgaggccatcgaggccctggatgctgccattgagtataagaatgaggccatcacatgccgccagcgggtgcttcgggcctcagcctcgttgctgtcccagtgcgagatgaacctcatggccaagctcagctacctctcatcctcagagaccagagccctcctctgcaagtattttgacaaggtggtgacgctccgagaggagcagcaccagcagcagattgccttctcggaactggagatgcagctggaggagcagcagaggctggtgtactggctggaggtggccctggagcggcagcgcctggagatggaccgccagctgaccctgcagcagaaggagcacgagcagaacatgcagctgctcctgcagcagagtcgagaccacctcggtgaagggttagcagacagcaggaggcagtatgaggcccggattcaagctctggagaaggaactgggccgttacatgtggataaaccaggaactgaaacagaagctcggcggtgtgaacgctgtaggccacagcaggggtggggagaagaggagcctgtgctcggagggcagacaggctcctggaaatgaagatgagctccacctggcacccgagcttctctggctgtcccccctcactgagggggccccccgcacccgggaggagacgcgggacttggtccacgctccgttacccttgacctggaaacgctcgagcctgtgtggtgaggagcaggggtcccccgaggaactgaggcagcgggaggcggctgagcccctggtggggcgggtgcttcctgtgggtgaggcaggcctgccctggaactttgggcctttgtccaagccccggcgggaactgcgacgagccagcccggggatgattgatgtccggaaaaaccccctgtaagccctcggggcagaccctgccttggagggagactccgagcctgctgaaaggggcagctgcctgttttgcttctgtgaagggcagtccttaccgcacaccctaaatccaggccctcatctgtaccctcactgggatcaacaaatttgggccatggcccaaaagaactggaccctcatttaacaaaataatatgcaaattcccaccacttacttccatgaagctgtggtacccaattgccgccttgtgtcttgctcgaatctcaggacaattctggtttcaggcgtaaatggatgtgcttgtagttcaggggtttggccaagaatcatcacgaaagggtcggtggtaaccaggttgtggtttaaatggtcttatgtatataggggaaactgggagactttaggatcttaaaaaaccatttaataaaaaaaaatctttgaaggga

SEQ ID NO: 146795 - DNA, 1375 bp, Homo sapiens
  Payload ID: 9046
  Gene Symbol: KIF7
  Gene Name: kinesin family member 7
  ENST ID: ENST00000445906
  CDS Start-End: 78-521
ctggggatggaaacctgactgcctggcccgggacggcgcttgcagccaggcagggcccagagcagtcctccctcggcatggggctggaggctcagaggctgccaggggctgaggaggccccagtgcgggttgccctgcgagttcgaccactgctgcccaaggagctgctgcacgggcatcagagctgcctgcaggtggagccagggcttggccgcgtcactctgggccgtgaccgacactttggcttccacgtggtgctggccgaggatgcggggcaggaggccgtgtaccaggcctgcgttcagcccctccttgaggccttcttcgagggcttcaatgccactgtctttgcctatggtcagacgggctcagggaagacatacaccatgggggaggccagtgtggagcaccatcctccagctctggcaggggcctatgagcttccgggcctgggggccatgggccgtgtccagctgaagtggcaggaggccctgcggtgtctccccagcctccctccttgaggatgagcagggcattgtcccgagggccatggccgaggccttcaagctcatcgatgagaacgacctgcttgactgtctggtacatgtgtcctacctggaagtgtacaaggaggagttccgagacctgctcgaggtgggcactgccagccgtgacatccagctccgggaagatgagcgcgggaatgttgtgctgtgcggggtgaaggaggtcgacgtggagggcctggatgaggtgctgagcctcctggagatgggcaacgcggcgcggcacacgggagccacgcacctcaaccacctgtctagccgctcacacacggtcttcaccgtgaccctggagcagcgggggcgcgcccccagccgcctaccccgccccgccccgggccagctgctcgtctccaagttccacttcgtggacctggcgggctcagagagggtgctcaagacgggcagcaccggcgagcggctcaaggagagcatccagatcaacagcagcctcctggcgctgggcaacgtcatcagcgccctgggggaccctcagcgccggggcagccacataccctaccgcgactccaagatcacccggatcctcaaagactcgctgggcgggaacgccaagacggtgatgatcgcctgcgtcagcccttcctcctccgacttcgacgagaccctcaacaccctcaactacgccagccgcgcccagaacatccgcaaccgcgccacggtcaactggcggcccgaggccgagcggccacccgaagagacggcgagcggcgcgcggggtccgccacggcaccgctccgagacccgcatcatccaccgcggccggcgcgccccaggcccagccaccgcctccg

SEQ ID NO: 146796 - DNA, 3311 bp, Homo sapiens
  Payload ID: 9047
  Gene Symbol: KIF9
  Gene Name: kinesin family member 9
  Uniprot ID: Q9HAQ2
  ENST ID: ENST00000265529
  CDS Start-End: 682-3054
gtggtgcccatcagcatgtggagccggccaccgcccctgcctccatagaagcccgctgccgcccagtccgcggtaccttgagggtcacgtcgcacagcttgccctgccgccggatctcctccatgacgccgtagccgcgactaggcaactcagacacggagaagtgcaccagatcctccagctcctccgcgccgtcctccaccatcttccccggccgctgcaactgcgcaggcctcgccggccggctagacactaaccagggcggggcgatagcgcacgccgacagccgctcggagcgcggagcagcaatcggacgggcctccgcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttca

SEQ ID NO: 146797 - DNA, 3357 bp, Homo sapiens
  Payload ID: 9047
  Gene Symbol: KIF9
  Gene Name: kinesin family member 9
  Uniprot ID: Q9HAQ2
  ENST ID: ENST00000335044
  CDS Start-End: 359-2731
gcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcagtgctcatctgagaactttgtcttatttcctgtctgaaaggacatattctctatgtatgtgtgaggtcagaactgagtctcaagtaggaaggcagaaaagtagctcagccaggctcctcctggcaggcctttgtcacactggtcagcccctttcctggatagacatcctagggtgggggtggtgagctcggtctgaggagctctgcttctcacagctccctcagaccctaagttctctcaagacatcttttctgtgtttctgagccagtgaagaagacaggaggaggccctccttcatttggcaaccaggggaggataaggtctagccacagagaccagaaagggatgaggcagagctggctccatgta

SEQ ID NO: 146798 - DNA, 741 bp, Homo sapiens
  Payload ID: 9047
  Gene Symbol: KIF9
  Gene Name: kinesin family member 9
  ENST ID: ENST00000456548
  CDS Start-End: 264-741
gacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcagggtgagaccaacaggattatagcctcccacactatgaacaaaaactcttccagatcacactgcattttcaccatctacttagaggcccattcccggaccttatcagaggaaa

SEQ ID NO: 146799 - DNA, 633 bp, Homo sapiens
  Payload ID: 9047
  Gene Symbol: KIF9
  Gene Name: kinesin family member 9
  ENST ID: ENST00000432493
  CDS Start-End: 278-553
gctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcactcactatca

SEQ ID NO: 146800 - DNA, 2707 bp, Homo sapiens
  Payload ID: 9047
  Gene Symbol: KIF9
  Gene Name: kinesin family member 9
  Uniprot ID: Q9HAQ2
  ENST ID: ENST00000452770
  CDS Start-End: 335-2707
acagccaggcagccccgcgtggggagtgcaggtggtttcggttgcggcagtcgcgtcccgggagcgtcgctgcctggtgaacgctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatag

SEQ ID NO: 146801 - DNA, 1521 bp, Homo sapiens
  Payload ID: 9047
  Gene Symbol: KIF9
  Gene Name: kinesin family member 9
  ENST ID: ENST00000443784
  CDS Start-End: 49-1050
gttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgggttccaggctgtggttataaggccagtatgagcagatggtattaagcacctgccatgtgcaccatgctatcttcactgagatttgccagcaggatgaagctagtcaccactgagcctgccatcaatgaaaagtatgatgctgaggaatggccaggatgtctgggcacagaatgaggaattgtacttttgctgtggaagagacagggtagcttctctgatgatccttcctgtcggcccccaccctaccatgtttcccggcagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgag

SEQ ID NO: 146802 - DNA, 640 bp, Homo sapiens
  Payload ID: 9047
  Gene Symbol: KIF9
  Gene Name: kinesin family member 9
  ENST ID: ENST00000425452
  CDS Start-End: 267-584
gtcagttttcgaactagagggggctttgggatcaccagtcggagcccttcgtgttacagtagtgactgaagatagacccacatatgaagattcagctgccctctgacttccagccattaccatcaccaaccaccgccatttcctgaatacctactctgtgctgggctctgccctggacattgtgaggggattcaaaagagataaaaagcacaatccttgccttcaagcagcttgtaatttaattttgggaactgaaacccactcaaatgaagcgacgtaagaatggtaacaagcagtatttcactagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaat

SEQ ID NO: 146803 - DNA, 740 bp, Homo sapiens
  Payload ID: 9047
  Gene Symbol: KIF9
  Gene Name: kinesin family member 9
  ENST ID: ENST00000425853
  CDS Start-End: 385-660
gggagcgtcgctgcctggtgaacggtgagcaggggctgctcgccggtgggagtggggagacgggaaaagggtgtgcgcccggactgctgaaagtggctggggtccaaaaaccgctttatctgggggttcccagctgggtcgctcatctctgaaacccaggcgaaggagggctcgacgtcgcgggagtcctttcaacctgaccgcggcttacggtcttcggagctaatgttcattggtcccacaaaggggtcccacgtcgcgtccaggacatagaggccgtgaggcagggagccagaggtcgtctggactcttccgtactagtcagttttcgaactagagggggctttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggtaacttaattaattaaatgttgtcttatgtaagaacctgaggagtaagagatgcaaatattttatggtgaataaaataaaagctcactcactatca

SEQ ID NO: 146804 - DNA, 2791 bp, Homo sapiens
  Payload ID: 9047
  Gene Symbol: KIF9
  Gene Name: kinesin family member 9
  Uniprot ID: Q9HAQ2
  ENST ID: ENST00000444589
  CDS Start-End: 359-2536
gcggccgccgtagttgaatctcctcggcgccggaagccccgccactccgcttcctggttcatgtgcggccttcgttccctcgctatctcgaccttgacttcgcatgtgcatccgccgaagtctttctagatcaatcggccccatctctcgtcttcccgattcggccatgacctcacccgtatcctcgacgtaggacctcggacttcatttccgccaccccgacacttccggaatccccggaagcgacccgttgccatggcgactatgtacacagccaggcagccccgcgtggggagtgcaggtggtttcggttgcggcagtcgcgtcccgggagcgtcgctgcctggtgaacgctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggacttt

SEQ ID NO: 146805 - DNA, 2694 bp, Homo sapiens
  Payload ID: 9048
  Gene Symbol: KIFC1
  Gene Name: kinesin family member C1
  Uniprot ID: Q9BW19
  ENST ID: ENST00000374523
  CDS Start-End: 451-2472
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaa

SEQ ID NO: 146806 - DNA, 2706 bp, Homo sapiens
  Payload ID: 9048
  Gene Symbol: KIFC1
  Gene Name: kinesin family member C1
  Uniprot ID: Q9BW19
  ENST ID: ENST00000428849
  CDS Start-End: 451-2472
gcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaa

SEQ ID NO: 146807 - DNA, 734 bp, Homo sapiens
  Payload ID: 9048
  Gene Symbol: KIFC1
  Gene Name: kinesin family member C1
  ENST ID: ENST00000411963
  CDS Start-End: 126-734
cggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacaggcccttccagtcacccgttgccttggcaatgtcatcaccaaccttttttggtgacagacccagggggccgatcttgggggccagggcagaagtggcaccgacttcacctctggtgcacctcagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaa

SEQ ID NO: 146808 - DNA, 2706 bp, Homo sapiens; identical to SEQ ID NO: 146806
  Payload ID: 9048
  Gene Symbol: KIFC1
  Gene Name: kinesin family member C1
  Uniprot ID: Q9BW19
  ENST ID: ENST00000448818
  CDS Start-End: 451-2472

SEQ ID NO: 146809 - DNA, 734 bp, Homo sapiens
  Payload ID: 9048
  Gene Symbol: KIFC1
  Gene Name: kinesin family member C1
  ENST ID: ENST00000450504
  CDS Start-End: 126-734
cggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacaggcccttccagtcacccgttgccttggcaatgtcatcaccaaccttttttggagacagacccagggggccgatcttgggggccagggcagaagtggcaccgacttcacctctggtgcacctcagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaa

SEQ ID NO: 146810 - DNA, 734 bp, Homo sapiens; identical to SEQ ID NO: 146809
  Payload ID: 9048
  Gene Symbol: KIFC1
  Gene Name: kinesin family member C1
  ENST ID: ENST00000426791
  CDS Start-End: 126-734

SEQ ID NO: 146811 - DNA, 631 bp, Homo sapiens
  Payload ID: 9048
  Gene Symbol: KIFC1
  Gene Name: kinesin family member C1
  ENST ID: ENST00000494554
  CDS Start-End: 1-464
gccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgcgattaccacccgtcagccttgtcaggacccgtgggtggttgtaggcttctccattccaatcccttttgtcttctagggcagggagcacatttgtgcagaaaggttttgcaggtatctgaggcactgctcacctggttccatttttaattattagcttttgagttaagttttttaaaaaacgggtgattaatttaacctgagaaagctgatt

SEQ ID NO: 146812 - DNA, 3646 bp, Homo sapiens
  Payload ID: 9049
  Gene Symbol: KIFC2
  Gene Name: kinesin family member C2
  Uniprot ID: Q96AC6
  ENST ID: ENST00000301332
  CDS Start-End: 378-2894
ggggctgtagggagaggaaggagaaccccggcgtgttgaaggctccgcgaaaccggagcggtgggggactacgcggagggtgggagggattccgagaggagggtcgcgggagccgtgggcgctctcagcccggtgtccgcggtgtaggggttggggcgcgccgggcggcgccgtgagaaacggcgggtctccaggtgcggccgcgggcacctgtttctagtacccccgtccccgcgctcgccttccagccgtgggagccgggccgtgggggcggccgtcgcgagcatgcgcaccggcactgcggcgggcgggcgccgagtctgggcgcggggacgcggggcggcgcgaagcggggccctctgccgccccgcgctcccatgtacgccttttactcgttgctcatctacatcttctacagcctcttccgcagggatggtggcgccgcggcggccgcggagcccggggaccccgcccagagagcccgcaagccccggggtcgccggcgcccagacctgcccgcgccagagctgtggaccgagctgaccggcctggccgccagctccgagcctgaggatgggtcggaaggcgcagccgagggccgcgcggccgcggtgtccctggaagaggccctactgcgcctcgccgagttcctctccgtccagctgggggcggaagagagctgcgggggcccggcggacctgggccagtctggcgaggtcccctcactgttgacagtgaccagtcagctcttggcccttctggcatggcttcgaagccccagggggaggcaggccctgctccaggggactcagccagcccctcgggtccggcccccctctccagatggatccacatcccaagaagaaagcccttcccacttcaccgcagtcccaggcgagccactgggggatgagacccagggacagcagcccctccagttggaggaggatcagagggcgtggcagcggctggagcagctcatcctgggacagctggaggagctgaagcagcagctggaacagcaggaggaggagttgggtcgactgcgcctgggcgtgggggcgacggactcagagaaaagggttcagcatctgactctggagaacgaggccctgaagcagagcctgagtctcatgcgggacctcctgctgcactggggccccgggccccccatcagggctccgcaggaggaggcagaggcattgctagagctccagggccggcttcaggaggcccaagacaccacagaagccctccgagcccagctgggggtgcaggaggtgcagctgcagggccttcaaggggccctccagcagctccagcaggagacggagcagaactgcaggcgtgagctacagcagatgcatgggcagctggcaggacttcgggcacggatggccagcctgcgtcagggctgcggggacctccgaggtttggtcagcacctttacccagagctgtcagggttcgctgagtgaggcccggggccaggtgtcctgggccttgggggcactgtcatctggagggcctggcactcagctccctgaggggcagcaagggcccccagccggatgcccagggcggctgccagaactcaagggaaatatccgtgtgctgtgtcggctgaggccagggacatcttctagccttgtgagtgtggagcctggcccagggggcaccgtcaccacctgctaccgggggcgccatcgtcgattccgcctagactgggtcttccctccagacgccagccaggaggaggtcttcagagagctggaacctgcggtgctgtcctgcctccgaggctacagcgtctgcatcttcacctatggccagacaggcaccgggaagacctacagcatggagggccctcctgaggaccccggcatagttcctagggcgctgcagtcgctgttccgggagatgggggccggccggcagcaccgggtgacactcagcatggtggagatctacaatgaggctgtcagggacctccttgctccagggcctcccgagcgcctggccgtgaggcagggcccagaaggccagggcgggatccaggtggctggcctcacccactgggacgtgcccaacctggagacattgcaccagatgctgaaactggggaggagcaaccgggccaccgccgccaccgccatgaaccagcgcagctcccgctcgcatgccctggtcacgctgacgctgcgcgcggcgtctccaccgcgcgctccaggcaccgcaggcacgctgcacctggtggacctggcgggatccgaacgcgcacggaaggcaggggcggccggcccgccgcggggagacccagacggcgcccggcgcctgcgggaggcccagaccataaaccgctcgctgctggcgctaggaggcgtgatggccgcactgcgggcccaccggccgcacgtgcccttccgcgactcgcagctcacgcgactgctgcagccggcgctgggcccaggcaccaccgcggtgctgctgctgcaggtgggcgccggggcggggcaggtgtgtgcgtgccggtcgccgcccacccgggcccgcccacccgcgcctcttgcccgcagatctccacgcggccggaggatctcggggagacagtctgctccctcaagttcgccgaccgagtgggtcaagtggagctggggccagcccggcgccgcagggtcccgcgctcctccgggacgccttcttccctcagcaccgacactccgctcaccgggaccccctgcacccctacgccgtcccctggcagtcctccatgccccagtcccgacaacggctcgggctcggctctcgcgcccgcagagggcctgcccctctagtcctgggtcgcggccctgcccatggggtctcaggccaggtctctgctggcagaggcggtagtaaagtccctgtaccccgtctcccagggcacaagctccctagcctctttggatccattgcccctgagctcccagagtcacccctccacctccgcagccagtgaagtgtgttgtgcctgctgaagtgatcaccccccgcccccagccctgcatcaggccacaggtcttggctttctccttatcaccatttgctgttatcacggcacacagcagggaatcccaggcccccccgccaagtggttacccaagtcaccactcctgacccaaaaatcaggcatggcattaaaacgttgcaaattcctttactgttatcccccccaccaccaggaccatgtagggtgcagtctttactccctaacccgtttcccgaaaaaggtgctacctcctttccagacagatgagagagggcaggacttcaggctggatccaccactgggctctccctcccccagcctggagcacgggaggggaggtgacggctggtgactgatggatgggtagtgggctgagaagaggggactaggaagggctattccaggctcagccctgctcctgcagctttgccgctgagtgtaggaaaaacaggcatgacagaccagggtgagggttgtgcccagctgggccacggccatgcgtggggtggcccaataaacaccgtggactcccagcaaggctgctgcctggtgtttcgaggctgctgtggtcgcagacagccgcctcgccttggctccctgtcaacaaggtgggggtggg

SEQ ID NO: 146813 - DNA, 3427 bp, Homo sapiens
  Payload ID: 9050
  Gene Symbol: KIFC3
  Gene Name: kinesin family member C3
  Uniprot ID: Q9BVG8
  ENST ID: ENST00000379655
  CDS Start-End: 259-2760
gcgggcgcgcgccgccgccccccgccggggtcggagccggttgccatgggaacgcgccgcggcccgagttaatcatttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacacaa

SEQ ID NO: 146814 - DNA, 3128 bp, Homo sapiens
  Payload ID: 9050
  Gene Symbol: KIFC3
  Gene Name: kinesin family member C3
  Uniprot ID: Q9BVG8
  ENST ID: ENST00000421376
  CDS Start-End: 559-2622
agagatgagactgaggtttctcaccggttcctaagcccagtcagagctgtcaggtaattacagggtaaccgacagcccagagccaggcgggcgtggagccggagcgtcagtctcgccgggcgctccttccctgcgcccctgtctggaaaagaggagacctggaagccgggttaaactttaacacgggtcgggcacagagcagggggaatcagctgcattccctctggccaagctggtcagagctctgcgggctgccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagct

SEQ ID NO: 146815 - DNA, 3379 bp, Homo sapiens
  Payload ID: 9050
  Gene Symbol: KIFC3
  Gene Name: kinesin family member C3
  Uniprot ID: Q9BVG8
  ENST ID: ENST00000445690
  CDS Start-End: 184-2664
tttcctgtggaaagtgtgcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacac

SEQ ID NO: 146816 - DNA, 2781 bp, Homo sapiens
  Payload ID: 9050
  Gene Symbol: KIFC3
  Gene Name: kinesin family member C3
  ENST ID: ENST00000540079
  CDS Start-End: 132-2306
aaggacagaacagaaccctgggccgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccg

SEQ ID NO: 146817 - DNA, 3047 bp, Homo sapiens
  Payload ID: 9050
  Gene Symbol: KIFC3
  Gene Name: kinesin family member C3
  Uniprot ID: Q9BVG8
  ENST ID: ENST00000541240
  CDS Start-End: 12-2558
agtgtgagtgcatgtgcgccagcgcgtgcaaggacacggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaa

SEQ ID NO: 146818 - DNA, 3018 bp, Homo sapiens
  Payload ID: 9050
  Gene Symbol: KIFC3
  Gene Name: kinesin family member C3
  ENST ID: ENST00000543930
  CDS Start-End: 562-2616
agctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaagtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggc

SEQ ID NO: 146819 - DNA, 551 bp, Homo sapiens
  Payload ID: 9050
  Gene Symbol: KIFC3
  Gene Name: kinesin family member C3
  ENST ID: ENST00000562984
  CDS Start-End: 374-551
ctcttctgaggctctaggtgccccagtagcagggccttctgcagcaaggccgggaactgctgcaccattgataccagagatgagactgaggtttctcaccggttcctaagcccagtcagagctgtcagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgt

SEQ ID NO: 146820 - DNA, 737 bp, Homo sapiens
  Payload ID: 9050
  Gene Symbol: KIFC3
  Gene Name: kinesin family member C3
  ENST ID: ENST00000562503
  CDS Start-End: 235-737
acacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtgggcgtctctttggcagcaggaggtgctcgagcttgtcggggccaccaggtgcggcccccatggtgcttaggatggtggaggccatgtcccagctccaggacgagaagacccagctacaggaggagctggtggtcctacaggagaggctggccctccgcgacagtgaccagcaggccacgtccacccagctgcagaaccaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaa

SEQ ID NO: 146821 - DNA, 777 bp, Homo sapiens
  Payload ID: 9050
  Gene Symbol: KIFC3
  Gene Name: kinesin family member C3
  ENST ID: ENST00000562311
  CDS Start-End: 568-777
gggaggggcgcgagcgggctggccgaggaggaggcggcggcgtggagctgcctcctgccggcgggccgggccgggccgagccccgggcgctgcggcgacgcctggatcctgcctccgccaggccgataccagagatgagactgaggtttctcaccggttcctaagcccagtcagagctgtcagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagacc

SEQ ID NO: 146822 - DNA, 577 bp, Homo sapiens
  Payload ID: 9050
  Gene Symbol: KIFC3
  Gene Name: kinesin family member C3
  ENST ID: ENST00000561524
  CDS Start-End: 314-577
gaatcagctgcattccctctggccaagctggtcagagctctgcgggctgccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtgggcgtctctttggcagcaggaggtgctcgagcttgtcggggccaccaggtgcggcccccatggtgcttaggatggtggaggccatgtcccagctccaggacgagaagacccagctacaggaggagctggtggtcctacaggagaggctggccctccgcgacagtgaccagcaggccacgtccacccagctgcagaaccaggtagaacacctgaaggagaagctcattagccaggcccaggaagtgagccgactgcgatctgagctggggggcaccgacttggagaagcaccgggacctgctgatggtggagaatgagcgactg

SEQ ID NO: 146823 - DNA, 297 bp, Homo sapiens
  Payload ID: 9050
  Gene Symbol: KIFC3
  Gene Name: kinesin family member C3
  ENST ID: ENST00000565351
  CDS Start-End: 283-297
tgatgaaacctcttttctttataaattacccagtctcaggtatttctttatagcagtgtgaaaactgactaatacaccatccatctccagaactcttttcatcttctgctactgaaatttgggcctcattaaagagtaactcctcattcgccatctgtctccgtgggtttgactgctcatgtagaacacctgaaggagaagctcattagccaggcccaggaagtgagccgactgcgatctgagctggggggcaccgacttggagaagcaccgggacctgctgatggtggagaatgag

SEQ ID NO: 146824 - DNA, 3225 bp, Homo sapiens
  Payload ID: 9050
  Gene Symbol: KIFC3
  Gene Name: kinesin family member C3
  Uniprot ID: Q9BVG8
  ENST ID: ENST00000465878
  CDS Start-End: 445-2508
gccgtccttggccaagagcgtgtgggctagctccggtctctgcccaggctggtaaacaagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtggcaccatgaatgtagagaatacaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacacaa

SEQ ID NO: 146825 - DNA, 424 bp, Homo sapiens
  Payload ID: 9050
  Gene Symbol: KIFC3
  Gene Name: kinesin family member C3
  ENST ID: ENST00000564891
  CDS Start-End: 110-424
ctcttctgaggctctaggtgccccagtagcagggccttctgcagcaaggccgggaactgctgcaccattggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcag

SEQ ID NO: 146826 - DNA, 623 bp, Homo sapiens
  Payload ID: 9050
  Gene Symbol: KIFC3
  Gene Name: kinesin family member C3
  ENST ID: ENST00000565684
  CDS Start-End: 227-623
cagcgccttccaggcatctccgcccaggtggctgggtttcccagcagaacatcgcattccagtgtctgccgcaagccctcttctgttaggtcaccctccaccatccgccttcttcagccatcaggattctcatttagaaagactgcaaagccctgtgtccaggttggaggcagccgggaggccacaggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttgg

SEQ ID NO: 146827 - DNA, 3221 bp, Homo sapiens
  Payload ID: 9050
  Gene Symbol: KIFC3
  Gene Name: kinesin family member C3
  Uniprot ID: Q9BVG8
  ENST ID: ENST00000562903
  CDS Start-End: 944-3007
gtgccatgtgccagctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaaaagacatgctttgtgtctcctcctccttctgccaggattgtaagtttcctgaggcctccccagccatgtggaactaactcttttcatcttctgctactgaaatttgggcctcattaaagagtaactcctcattcgccatctgtctccgtgggtttgactgctcatgtacttactgaacacctactgtgtaccaggcactgttccaggcactgggagtacagtgctgaacacaacagacaaaaatccctgccttcgcatatatcatctcgtttaatcctcgagacagcttccatgaggtagcctcattatacaaataaggaaactaagagacatagagaacttaagagacttgtccaaggttacccagcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggcctgacggctggggctgcagagtctctagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtg

SEQ ID NO: 146828 - DNA, 681 bp, Homo sapiens
  Payload ID: 9050
  Gene Symbol: KIFC3
  Gene Name: kinesin family member C3
  ENST ID: ENST00000563028
  CDS Start-End: 218-681
agtccaggcagacagcatcatgggtgaaggcttggagagctggtgaggcttggtggagacagcagctgattgtggctgatgaccaaagggcagggtcaaaggggcaggtggtaatctgggaaggaggggacggacttcatccgaggtgtcatgttcaggaatttgtactttatcctgaaggctacaggacaacccagtaaaacgtattgctcggaaaatggcacagatggagtttcttttcaggaagaacactctgacagctgcatggaagcccagacaccaggaaaccctcagattggaggctggtgtcccggagcagtgcaaggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggt

SEQ ID NO: 146829 - DNA, 698 bp, Homo sapiens
  Payload ID: 9050
  Gene Symbol: KIFC3
  Gene Name: kinesin family member C3
  ENST ID: ENST00000569619
  CDS Start-End: 684-698
agcaggattctattctggctgtgccatgtgccagctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaaaactcttttcatcttctgctactgaaatttgggcctcattaaagagtaactcctcattcgccatctgtctccgtgggtttgactgctcatgtagaacacctgaaggagaagctcattagccaggcccaggaagtgagccgactgcgatctgagctggggggcaccgacttggagaagcaccgggacctgctgatggtggagaatgag

SEQ ID NO: 146830 - DNA, 651 bp, Homo sapiens
  Payload ID: 9050
  Gene Symbol: KIFC3
  Gene Name: kinesin family member C3
  ENST ID: ENST00000566648
  CDS Start-End: 80-651
agagtgacttgctttctcctcttccgcacccgggggtgtggagagtgagggagaatattgctgctggctctggaataaaatgctgcctctgtttgggagacaaagaacagagtggctcctccaggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaa

SEQ ID NO: 146831 - DNA, 509 bp, Homo sapiens
  Payload ID: 9050
  Gene Symbol: KIFC3
  Gene Name: kinesin family member C3
  ENST ID: ENST00000567059
  CDS Start-End: 13-509
cagtgtgagtgcatgtgcgccagcgcgtgcaaggacacggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcagcaggccctgcaggacaaggggtgcaagagccagagtcaggggacgaaagaagagaagctttggaagagacaggcgccggcccccaggcgggcccgggaggcccgggaagctggtgg

SEQ ID NO: 146832 - DNA, 1081 bp, Homo sapiens
  Payload ID: 9050
  Gene Symbol: KIFC3
  Gene Name: kinesin family member C3
  ENST ID: ENST00000565270
  CDS Start-End: 242-1081
attgtgagctgagtgactgcagtaacacgtgatgtggtgttgctgaaggacagcatggttggggaggtggctggacttgtagctggtggtcccagcggccctggaagcccccccaccagcctccctcccaccaccctcccaggtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatcc

SEQ ID NO: 146833 - DNA, 564 bp, Homo sapiens
  Payload ID: 9050
  Gene Symbol: KIFC3
  Gene Name: kinesin family member C3
  ENST ID: ENST00000569112
  CDS Start-End: 384-564
agctgcctcctgccggcgggccgggccgggccgagccccgggcgctgcggcgacgcctggatcctgcctccgccaggccgataccagagatgagactgaggtttctcaccggttcctaagcccagtcagagctgtcagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcag

SEQ ID NO: 146834 - DNA, 788 bp, Homo sapiens
  Payload ID: 9050
  Gene Symbol: KIFC3
  Gene Name: kinesin family member C3
  ENST ID: ENST00000565481
  CDS Start-End: 347-788
ggatgggaagacacgtactggtatgagagcccgcgtgagaagtataccagagatgagactgaggtttctcaccggttcctaagcccagtcagagctgtcagggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtgg

SEQ ID NO: 146835 - DNA, 810 bp, Homo sapiens
  Payload ID: 9050
  Gene Symbol: KIFC3
  Gene Name: kinesin family member C3
  ENST ID: ENST00000565397
  CDS Start-End: 1-589
cctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacagggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctgg

SEQ ID NO: 146836 - DNA, 443 bp, Homo sapiens
  Payload ID: 9050
  Gene Symbol: KIFC3
  Gene Name: kinesin family member C3
  ENST ID: ENST00000569222
  CDS Start-End: 132-443
aaggacagaacagaaccctgggccgcaggcaggtggctggtgggtatcccgcctcccacccccagcaaacactggcaaaccccactctccctgcatcagggtctgagtgcctggcaggggcggcagtggagatgatcaaggtagaacacctgaaggagaagctcattagccaggcccaggaagtgagccgactgcgatctgagctgcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggct

SEQ ID NO: 146837 - DNA, 3071 bp, Homo sapiens
  Payload ID: 9050
  Gene Symbol: KIFC3
  Gene Name: kinesin family member C3
  ENST ID: ENST00000564136
  CDS Start-End: 743-2239
ggctgtgccatgtgccagctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaaaagacatgctttgtgtctcctcctccttctgccaggattgtaagtttcctgaggcctccccagccatgtggaactaactcttttcatcttctgctactgaaatttgggcctcattaaagagtaactcctcattcgccatctgtctccgtgggtttgactgctcatgtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggcttagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagacggcagtgggcagctgtatgtaccagggctgactgagttccaagtgcagagcgtggacgacatcaacaaggtgtggaggcgggagcccctgaccacagccacactgctctagaggacacaactgggtttgaatgtaggctctgctgtgtcctaagcacgcacccttgggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaa

SEQ ID NO: 146838 - DNA, 3360 bp, Homo sapiens
  Payload ID: 9051
  Gene Symbol: KIF2A
  Gene Name: kinesin heavy chain member 2A
  Uniprot ID: O00139
  ENST ID: ENST00000381103
  CDS Start-End: 486-2546
gactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggtaaatacgagttcacagtataccagcaaaagtaggatttacatattattttgaagattctgggtgcacagcaacacctgtccctggtatacacccaagggagaggaaatcaccaccttgtgaagatatctgcactctcgcgttcattgcagcattattcacagtagccaagatagggaagcaacctaaatgtccatcgatgggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 146839 - DNA, 2315 bp, Homo sapiens
  Payload ID: 9051
  Gene Symbol: KIF2A
  Gene Name: kinesin heavy chain member 2A
  Uniprot ID: O00139
  ENST ID: ENST00000407818
  CDS Start-End: 22-2256
gctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagagtaaaggagtttggaattagtccatcagacattcccttctcacagggtagtggcagtcgccctgatctctctccttcttatgaatatgacgacttttctccttcagttaccagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttc

SEQ ID NO: 146840 - DNA, 2539 bp, Homo sapiens
  Payload ID: 9051
  Gene Symbol: KIF2A
  Gene Name: kinesin heavy chain member 2A
  Uniprot ID: O00139
  ENST ID: ENST00000401507
  CDS Start-End: 312-2432
gcctccccagcgtcggctccccggcgggcggtgcgggccctcccactctaccccgcgccgtctcacggccccggccctagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaa

SEQ ID NO: 146841 - DNA, 392 bp, Homo sapiens
  Payload ID: 9051
  Gene Symbol: KIF2A
  Gene Name: kinesin heavy chain member 2A
  ENST ID: ENST00000512006
  CDS Start-End: 1-392
gggcagactggaagtggaaaaactcatgtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaaca

SEQ ID NO: 146842 - DNA, 874 bp, Homo sapiens
  Payload ID: 9051
  Gene Symbol: KIF2A
  Gene Name: kinesin heavy chain member 2A
  ENST ID: ENST00000514082
  CDS Start-End: 22-874
gctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaa

SEQ ID NO: 146843 - DNA, 2219 bp, Homo sapiens
  Payload ID: 9051
  Gene Symbol: KIF2A
  Gene Name: kinesin heavy chain member 2A
  Uniprot ID: O00139
  ENST ID: ENST00000506857
  CDS Start-End: 87-2069
agggcttaatagttttccaagtgcttcaagacatgttagctaattggatcttcacaggaactctatgaggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaac

SEQ ID NO: 146844 - DNA, 549 bp, Homo sapiens
  Payload ID: 9051
  Gene Symbol: KIF2A
  Gene Name: kinesin heavy chain member 2A
  ENST ID: ENST00000512541
  CDS Start-End: 310-549
gcattttaccggcttggcctctgacggggatggggatgggggtgggggagcgggaagaccagcgatttcacatttagagaaccgactgctggtcggaggccgagatggggggaaagagccagttccgtcgccttaaactgccgtctggttgtcaggcctccccggtttcgtcgtcgaccatgctgctttcttttttgccacttcttgggagaaaaatgtggagaatatcgcgctgagccatgaataagggtgggggagcaatgggaagaaatattcgatgggcttctccaaggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttca

SEQ ID NO: 146845 - DNA, 2294 bp, Homo sapiens
  Payload ID: 9052
  Gene Symbol: KLC1
  Gene Name: kinesin light chain 1
  Uniprot ID: Q07866
  ENST ID: ENST00000246489
  CDS Start-End: 256-2169
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtcc

SEQ ID NO: 146846 - DNA, 2524 bp, Homo sapiens
  Payload ID: 9052
  Gene Symbol: KLC1
  Gene Name: kinesin light chain 1
  Uniprot ID: Q07866
  ENST ID: ENST00000334553
  CDS Start-End: 260-2179
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgcctta

SEQ ID NO: 146847 - DNA, 2271 bp, Homo sapiens
  Payload ID: 9052
  Gene Symbol: KLC1
  Gene Name: kinesin light chain 1
  Uniprot ID: Q07866
  ENST ID: ENST00000347839
  CDS Start-End: 260-2146
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtcc

SEQ ID NO: 146848 - DNA, 15091 bp, Homo sapiens
  Payload ID: 9052
  Gene Symbol: KLC1
  Gene Name: kinesin light chain 1
  Uniprot ID: Q07866
  ENST ID: ENST00000348520
  CDS Start-End: 320-2041
ggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcata

SEQ ID NO: 146849 - DNA, 2322 bp, Homo sapiens
  Payload ID: 9052
  Gene Symbol: KLC1
  Gene Name: kinesin light chain 1
  ENST ID: ENST00000380038
  CDS Start-End: 294-2024
gagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacag

SEQ ID NO: 146850 - DNA, 3250 bp, Homo sapiens
  Payload ID: 9052
  Gene Symbol: KLC1
  Gene Name: kinesin light chain 1
  Uniprot ID: Q07866
  ENST ID: ENST00000389744
  CDS Start-End: 270-1952
gcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagta

SEQ ID NO: 146851 - DNA, 2416 bp, Homo sapiens
  Payload ID: 9052
  Gene Symbol: KLC1
  Gene Name: kinesin light chain 1
  ENST ID: ENST00000445352
  CDS Start-End: 200-1849
ctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtat

SEQ ID NO: 146852 - DNA, 2453 bp, Homo sapiens
  Payload ID: 9052
  Gene Symbol: KLC1
  Gene Name: kinesin light chain 1
  Uniprot ID: Q07866
  ENST ID: ENST00000452929
  CDS Start-End: 256-2112
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgcctta

SEQ ID NO: 146853 - DNA, 875 bp, Homo sapiens
  Payload ID: 9052
  Gene Symbol: KLC1
  Gene Name: kinesin light chain 1
  ENST ID: ENST00000537046
  CDS Start-End: 1-805
aaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgcc

SEQ ID NO: 146854 - DNA, 710 bp, Homo sapiens
  Payload ID: 9052
  Gene Symbol: KLC1
  Gene Name: kinesin light chain 1
  ENST ID: ENST00000535194
  CDS Start-End: 1-181
tcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgata

SEQ ID NO: 146855 - DNA, 2555 bp, Homo sapiens
  Payload ID: 9052
  Gene Symbol: KLC1
  Gene Name: kinesin light chain 1
  Uniprot ID: Q07866
  ENST ID: ENST00000554228
  CDS Start-End: 256-1938
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttt

SEQ ID NO: 146856 - DNA, 2188 bp, Homo sapiens
  Payload ID: 9052
  Gene Symbol: KLC1
  Gene Name: kinesin light chain 1
  ENST ID: ENST00000557575
  CDS Start-End: 260-1915
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaa

SEQ ID NO: 146857 - DNA, 2265 bp, Homo sapiens
  Payload ID: 9052
  Gene Symbol: KLC1
  Gene Name: kinesin light chain 1
  Uniprot ID: Q07866
  ENST ID: ENST00000557450
  CDS Start-End: 256-1950
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtaca

SEQ ID NO: 146858 - DNA, 540 bp, Homo sapiens
  Payload ID: 9052
  Gene Symbol: KLC1
  Gene Name: kinesin light chain 1
  ENST ID: ENST00000557172
  CDS Start-End: 91-540
ataattcattcactcgcctcccactgggagtccacaatggcctaatgcacgtttcaagctcttggtttctatcaaacggctcgctcaagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagttt

SEQ ID NO: 146859 - DNA, 2426 bp, Homo sapiens
  Payload ID: 9052
  Gene Symbol: KLC1
  Gene Name: kinesin light chain 1
  ENST ID: ENST00000554280
  CDS Start-End: 256-2085
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgcctta

SEQ ID NO: 146860 - DNA, 535 bp, Homo sapiens
  Payload ID: 9052
  Gene Symbol: KLC1
  Gene Name: kinesin light chain 1
  ENST ID: ENST00000557686
  CDS Start-End: 1-133
catgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctagggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtac

SEQ ID NO: 146861 - DNA, 535 bp, Homo sapiens
  Payload ID: 9052
  Gene Symbol: KLC1
  Gene Name: kinesin light chain 1
  ENST ID: ENST00000555856
  CDS Start-End: 1-452
ggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttccct

SEQ ID NO: 146862 - DNA, 630 bp, Homo sapiens
  Payload ID: 9052
  Gene Symbol: KLC1
  Gene Name: kinesin light chain 1
  ENST ID: ENST00000553436
  CDS Start-End: 1-485
ccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggc

SEQ ID NO: 146863 - DNA, 976 bp, Homo sapiens
  Payload ID: 9052
  Gene Symbol: KLC1
  Gene Name: kinesin light chain 1
  ENST ID: ENST00000553325
  CDS Start-End: 1-395
atgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaggaaaatgaagctcgggctggttaactgacttgctcagcgtcccatggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaa

SEQ ID NO: 146864 - DNA, 2467 bp, Homo sapiens
  Payload ID: 9052
  Gene Symbol: KLC1
  Gene Name: kinesin light chain 1
  ENST ID: ENST00000555836
  CDS Start-End: 260-2152
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagatggcactggatctttaaaacgcagtggttcctttagcaaactccgggcttccattagacgcagcagtgagaagctggttaggaagctgaagggaggaagttcacgagagagtgagccaaagaaccccggcatgaagcgtgccagctctctgaatgtccttaacgtgggtggcaaggctgctgaagatcgctttcaaggcgtctctggccgagcctctttttgtggaaaacgacagcagcagcagtggcctggaagacgccaccgctaactgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtaca

SEQ ID NO: 146865 - DNA, 3135 bp, Homo sapiens
  Payload ID: 9052
  Gene Symbol: KLC1
  Gene Name: kinesin light chain 1
  Uniprot ID: Q07866
  ENST ID: ENST00000553286
  CDS Start-End: 260-1942
cggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaa

SEQ ID NO: 146866 - DNA, 2229 bp, Homo sapiens
  Payload ID: 9052
  Gene Symbol: KLC1
  Gene Name: kinesin light chain 1
  ENST ID: ENST00000634686
  CDS Start-End: 256-2010
cgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcgaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaaatgaagcgtgccagctctctgaatgtccttaacgtgggtggcaaggctgctgaagatcgctttcaagaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccg

SEQ ID NO: 146867 - DNA, 2990 bp, Homo sapiens
  Payload ID: 9053
  Gene Symbol: KLC2
  Gene Name: kinesin light chain 2
  Uniprot ID: Q9H0B6
  ENST ID: ENST00000316924
  CDS Start-End: 218-2086
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctga

SEQ ID NO: 146868 - DNA, 3755 bp, Homo sapiens
  Payload ID: 9053
  Gene Symbol: KLC2
  Gene Name: kinesin light chain 2
  ENST ID: ENST00000394065
  CDS Start-End: 1019-2584
gccagctgtggtggtgtgcacccgtagtcccagttactcaggaggctgagggggaaggaccacttgagcctggaaggtagaggctgcagtgagctgtgacggtgccatagcccttcggcccaggtgacagagtgagacattgtcttaaattaaaaaaaaaaaaaaaaaagagagagcaagaagggaggttggaccctaggcaggaaggcaggaagagactggaaactaaggaaaggagttgcagaggctggggagaggggtgggggttgaggccaaggcctttggatacttttcctgcccctgtggctcctcatgccaactgagcatttgggacacatgccccttccctacctgggagctgcagaaaggcaggggatgctgtggcccctcagcagaagtggggatggagtctttgggtggtccttcagccatctagcagagttctgtgggcaagcgctagccctgaggcagggagcagtaacctactggctgtggcagcagaggcttgagtacaacccagggagagacgaaggaaggggctagtagctcagggaaagcacagcaccccaactagcccttttggggttctcctgatcctagaaggaaggaactggggactcccaagcctcctgggtttgggctttgcattatggtgtgtcgggggccttgaggagattctcccttgacaagcagagaaaagacctgcagctcctcactgtagggccaggcctggcccttcactgggtgccagagcccaactaggcccaggctacagtcataggcgagggggtcgacaggcctccgacccttacctgggctggttgcacaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccaggtaggggcaggcgggtgtctgggcactgggcagctgcggccggggctgcatgcgtgctgccaagcttccctccagcatgcctcttcatccagcaacagttcctggctctgtctcaggcctactttgggctggacaacggggagacacgaggggaacccagcctctcctgggggtggacgtgtaaacggccagtgctaacaccgtcactgtggagatggacgggagtgtcagggcaccagggtgtggccttgggtcagaactgccattgcctctgcccagctcagggattccggctgcctctgccaggtcagaccccttcaggccagggaggcacagactggcagcagcacagggctgagccacctgccccctctgcccacagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 146869 - DNA, 2591 bp, Homo sapiens
  Payload ID: 9053
  Gene Symbol: KLC2
  Gene Name: kinesin light chain 2
  Uniprot ID: Q9H0B6
  ENST ID: ENST00000394066
  CDS Start-End: 51-1688
aggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 146870 - DNA, 2898 bp, Homo sapiens
  Payload ID: 9053
  Gene Symbol: KLC2
  Gene Name: kinesin light chain 2
  Uniprot ID: Q9H0B6
  ENST ID: ENST00000394067
  CDS Start-End: 181-2049
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggc

SEQ ID NO: 146871 - DNA, 1557 bp, Homo sapiens
  Payload ID: 9053
  Gene Symbol: KLC2
  Gene Name: kinesin light chain 2
  ENST ID: ENST00000394078
  CDS Start-End: 165-1166
gacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgt

SEQ ID NO: 146872 - DNA, 620 bp, Homo sapiens
  Payload ID: 9053
  Gene Symbol: KLC2
  Gene Name: kinesin light chain 2
  ENST ID: ENST00000440228
  CDS Start-End: 123-620
ctcgatggccccgccccgtccccctcccgctggagccggcccggcccgcgctcctttaaggcagcgaacgggccaagagaagcgtgtttcgccccctccgacgccaccgagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgac

SEQ ID NO: 146873 - DNA, 3015 bp, Homo sapiens
  Payload ID: 9053
  Gene Symbol: KLC2
  Gene Name: kinesin light chain 2
  Uniprot ID: Q9H0B6
  ENST ID: ENST00000417856
  CDS Start-End: 244-2112
gcgagccagataacagcggcactcacttctcgggtcttcgtgagcattaagtcaatgaacccagggcaccaaagcgcgcaacacgcagtaggcgctcagttagtggcgcctcgctctgtactccaggaagcccaaccttctccctgcgcctcagtttctcccgacgtcctcgatggcgccatggcgccacactaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 146874 - DNA, 2721 bp, Homo sapiens
  Payload ID: 9053
  Gene Symbol: KLC2
  Gene Name: kinesin light chain 2
  Uniprot ID: Q9H0B6
  ENST ID: ENST00000421552
  CDS Start-End: 181-1818
gtgtttcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctctggccatccgggagaaaacactgggcaaggaccacccagccgtggctgcgacactaaacaacctggcagtcctgtatggcaagaggggcaagtacaaggaggctgagccattgtgcaagcgggcactggagatccgggagaaggtcctgggcaagtttcacccagatgtggccaagcagctcagcaacctggccctgctgtgccagaaccagggcaaagctgaggaggtggaatattactatcggcgggcactggagatctatgctacacgcctcgggcccgatgaccccaatgtggccaagaccaagaacaacctggcttcctgctacctgaagcagggcaagtaccaggatgcggagaccttgtacaaggagatcctcacccgcgctcatgagaaagagtttggctctgtcaatggggacaacaagcccatctggatgcacgcagaggagcgggaggaaagcaaggataagcgccgggacagcgccccctatggggaatacggcagctggtacaaggcctgtaaagtagacagccccacagtcaacaccaccctgcgcagcttgggggccctataccggcgccagggcaagctggaagccgcgcacacactagaggactgtgccagccgtaaccgcaagcagggtttggaccccgcaagccagaccaaggtggtagaactgctgaaagatggcagtggcaggcggggagaccgccgcagcagccgagacatggctgggggtgccgggcctcggtctgagtctgacctcgaggacgtgggacctacagctgagtggaatggggatggcagtggctccttgaggcgcagcggttcctttgggaaactccgggatgccctgaggcgcagcagtgagatgctggtaaagaagctgcaggggggcaccccccaggagccccctaaccccaggatgaagcgggccagttccctcaacttcctcaacaagagcgtggaagagccgacccagcctggaggcacaggtctctctgacagccgcactctcagctccagctccatggacctctcccgacgaagctccctggtgggctaatgctgaaggggcagccagtcaccagagcgcccacctggcacacccccctcaccccagccctgcgcatgggcctgctgcttgtcccgcctgtctctcccacagcccctgtcttttctgttcaatctcagggtaaccttctcccttgtcatctcagcctgagccctggaggctgggcctgcccactccagctccatcccttatttattccttccagcagggccctcttccctaggttcgggccagcaggaggtgccggctggagtctccaccatagactcagtggcctggcctccccagaccccagagccaagaacactaagcactcgccggcccttcggcaccctcgccctccctcccgactcaacccggccgttgcttctgtatatagagaaataagttattggccgcgcgcctcccttcagtccacggtactacccgggcctcccctcgtccctcttctagtggtaccgcccaggccttaatcacccccattccgtgcggtggtatctcccaggctctacattctcgggagcggcgcctcccaagggggtcctgggaccttctcgcgctcctcctggcctctgagggatgcgtcctacccgcgccatcgccccgtggcccaggacggggacctccccttagtccgtcctcccaccgccgggccctgccccgcatcccggccttatgcactgcccctcccacccggccccgcccaggcacggccgaccccgccccgggcaccgcccaccgagccatcctgcctcgcctccccccacgcctgcagcttctcgcgaggggcggcgacggtcccctggtggcaggaggggctccccctgttgcgggtgaggcggctgctctcatattttcagatgttgctgtagaaataaagacggtttaaatctg

SEQ ID NO: 146875 - DNA, 1073 bp, Homo sapiens
  Payload ID: 9053
  Gene Symbol: KLC2
  Gene Name: kinesin light chain 2
  ENST ID: ENST00000475757
  CDS Start-End: 560-1073
gccttttcagggaaggcctcagggcgttgcgctggcctaggggaggggtcgtcgtgggcgtagcctggaaggactgggggccgcgtactcagcccctctagtgggagcgcctccgcagggtcggctcgtcgggaggatgggctccgcggcttggcctgccttttggggatggggctgtccgaggggctgggcccggatcgccggaggggccagggtctcctgcacaggagtgagcccccacgttccccatacctgtcctggttagggggtccccggggaaacccggacactgagccgcctaagtcggcctgagccggtggtctggggccgaagcaggatccggctgcaccgcattgcgtctcccaggcctagacaagctaggcgcgccctctgtaggccaagcgcgggcacggtgcgggctgccggctgggggacctgggcacacgggagactcaggcgtccggggaccgcctgtttacctaatccggggcggacggcggtgtggccccaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaagttggatgaagacgcctcccctaacgaggagaagggggacgtccccaaagacacactggatgacctgttccccaatgagg

SEQ ID NO: 146876 - DNA, 643 bp, Homo sapiens
  Payload ID: 9053
  Gene Symbol: KLC2
  Gene Name: kinesin light chain 2
  ENST ID: ENST00000461611
  CDS Start-End: 76-643
ggtgcgggtccgggtgaagcgggaggcagccagagtcggagccgggcccgagcaccaggcgcagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggaggagaagggggacgtccccaaagacacactggatgacctgttccccaatgaggatgagcagagcccagcccctagcccaggaggaggggatgtgtctggtcagcatgggggctacgagatcccggcccggctccgcaccctgcacaacctggtgatccaatacgcctcacagggccgctacgaggtagctgtgccactctgcaagcaggcactcgaagacctggagaagacgtcaggccacgaccaccctgacgttgccaccatgctgaacatcctggcactggtctatcgggatcagaacaagtacaaggaggctgcccacctgctcaatgatgctc

SEQ ID NO: 146877 - DNA, 559 bp, Homo sapiens
  Payload ID: 9053
  Gene Symbol: KLC2
  Gene Name: kinesin light chain 2
  ENST ID: ENST00000531240
  CDS Start-End: 244-559
gcgagccagataacagcggcactcacttctcgggtcttcgtgagcattaagtcaatgaacccagggcaccaaagcgcgcaacacgcagtaggcgctcagttagtggcgcctcgctctgtactccaggaagcccaaccttctccctgcgcctcagtttctcccgacgtcctcgatggcgccatggcgccacactaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggaga

SEQ ID NO: 146878 - DNA, 594 bp, Homo sapiens
  Payload ID: 9053
  Gene Symbol: KLC2
  Gene Name: kinesin light chain 2
  ENST ID: ENST00000526758
  CDS Start-End: 160-594
ctcgatggccccgccccgtccccctcccgctggagccggcccggcccgcgctcctttaaggcagcgaacgggccaagagaagcgtgtttcgccccctccgacgccaccgaggcccggcgcccgcctgcccgcaccctcgtcctcacagacgccacagccatggccatgatggtgtttccgcgggaggagaagctgagccaggatgagatcgtgctgggcaccaaggctgtcatccagggactggagactctgcgtggggagcatcgtgccctgctggctcctctggttgcacctgaggccggcgaagccgagcctggctcgcaggagcgctgcatcctcctgcgtcgctccctggaagccattgagcttgggctgggggaggcccaggtgatcttggcattgtcgagccacctgggggctgtagaatcagagaagcagaagctgcgggcgcaggtgcggcgtctggtgcaggagaaccagtggctgcgtgaggagctggcggggacacagcagaagctgcagcgcagtgagcaggccgtggcccagctcgaggaggagaagcagcacttgctgttcatgagccagatccgcaag

SEQ ID NO: 146879 - DNA, 1780 bp, Homo sapiens
  Payload ID: 9054
  Gene Symbol: KLC3
  Gene Name: kinesin light chain 3
  Uniprot ID: Q6P597
  ENST ID: ENST00000391946
  CDS Start-End: 103-1617
cgcccggcgcagcgggagcggcggggcgtgcctggcctgcgggacgcgactgatcgcagtggggcgaagcggggccggagccgcccgcggtcaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 146880 - DNA, 1820 bp, Homo sapiens
  Payload ID: 9054
  Gene Symbol: KLC3
  Gene Name: kinesin light chain 3
  Uniprot ID: Q6P597
  ENST ID: ENST00000470402
  CDS Start-End: 101-1657
aggatgggtggagcagggaagagccaggatggggagaagttaggggtcctgatggccattatgggaatagaggctgggggccaactgactggcccgggcaatgattccccaaacccctcaccattgctccccaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgacagtgag

SEQ ID NO: 146881 - DNA, 2006 bp, Homo sapiens
  Payload ID: 9054
  Gene Symbol: KLC3
  Gene Name: kinesin light chain 3
  ENST ID: ENST00000589373
  CDS Start-End: 817-2006
tccacccacctcggtctcccaaagtgccaggattacaggcgtgagccactgcgcctggccattttatttttatttttatttttttacattttatttttggttcatggttttttacattttattttggtacaattttattttggagacaggttcttacctcttgccccactctttttcacccaagctggaatacagtggtgccatcatagctcactgcaaccttgacctctggggatcccacctcaatctcccaagcagctgcaactacaggtgtgcgccaccacacttggctcattttaacttttttttttttttgtggagatggggatcttgctatattgcccaggctggtctcaaactcctggtctcaagcaatcctcctgccttggcctctcaaagtgctgggattacaggtgtgagccaccatgcctggtcaatagctctaaaatggatgtggggttggctgacagttggccaatccaggccgggctcagatgggaagttctgcttcatatgggaaccttgtggagtgcaggctgaggggagaggaagctctcaggggaagcccgtctcatggtgatgctgagatgcaaaaagaaatgttcaaggtctcttgaggcctaagctcagaactgacacgactgtcacttgtgcccctctgctattggccaaagcaagtcacatggccacaccaaaagttcaaggcccatcattttgtcgtcctccacagataggttcatcctatgttccccaagttggtctcaaactcctaggctccagcaatcctcctgaagccctgggattacaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagct

SEQ ID NO: 146882 - DNA, 1764 bp, Homo sapiens
  Payload ID: 9054
  Gene Symbol: KLC3
  Gene Name: kinesin light chain 3
  Uniprot ID: Q6P597
  ENST ID: ENST00000585434
  CDS Start-End: 95-1606
gcagcgggagcggcggggcgtgcctggcctgcgggacgcgactgatcgcagtggggcgaagcggggccggagccgcccgcggtcaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgtgccagcgcgctttggagatccgagagaaggtcctgggtgctgaccacccagatgtggccaagcagctcaacaacctggccctgctgtgccagaaccagggcaagtttgaggacgtggagcggcactatgcccgggccctgagcatctatgaggcactgggcgggccccatgaccccaacgtggccaagaccaagaacaacctggcctcagcctacctgaaacagaacaagtatcaacaagcggaagagctgtacaaagaaatcctccacaaggaggacctacccgcccctctcggtgcccccaacacaggcacagctggtgacgcagaacaggcccttcgccgcagcagctcactctccaagatccgtgagtctatcaggcgaggaagtgagaagctggtctcccggctccgaggcgaggcggcggcaggagcagccggaatgaagagagccatgtcactcaacacactgaacgtggatgctccaagggctcctgggactcagtttcccagctggcacctggacaaggcccctcggaccctcagcgccagcacccaggacctgagcccccactaacgtccagtgaactgcgctggccgcagcttcttgggaacagtgcaggagggatgggctggtggggtgagagggggtctatcatctcctggcccccccttgcctctgggtacctggtggatagctgccttctcctgcgattaaaggctgtggacgtgaca

SEQ ID NO: 146883 - DNA, 809 bp, Homo sapiens
  Payload ID: 9054
  Gene Symbol: KLC3
  Gene Name: kinesin light chain 3
  ENST ID: ENST00000590063
  CDS Start-End: 338-809
ggagggcggagcccctgttcccccagggtccatctgttgcctgggagccaacacatggccccatcctcattccccccaacctagaggcctcctgggcttctgggggccctggcccctcggccctctcctcccaccccacccacccccagtggtctgactggttcccgacaaaaacaccctaagaatgagctcacgcagaggctgccgcctccacacgccccgcctcactctgccggcagaggagggtgcctctggtcccaggtcacacggccaaccgggagctctgggccaggggatccaagggccttggggtggggaaggctggccaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacc

SEQ ID NO: 146884 - DNA, 973 bp, Homo sapiens
  Payload ID: 9054
  Gene Symbol: KLC3
  Gene Name: kinesin light chain 3
  ENST ID: ENST00000589837
  CDS Start-End: 82-973
cggggcgtgcctggcctgcgggacgcgactgatcgcagtggggcgaagcggggccggagccgcccgcggtcaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccagcagtctgagtccccgcctcgccgagacagcctggcctccctgttccccagcgaggaggaggagaggaaaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccgggaccagaacaagtacaaagaagccacagaccttctccatgatgccctgcagatccgggagcagacgctgggccctgagcaccccgcggtggccgccacgctcaacaacttggctgtcctctatgggaagcgtgggcgttaccgggaggcagagcccctgt

SEQ ID NO: 146885 - DNA, 2688 bp, Homo sapiens
  Payload ID: 9055
  Gene Symbol: KLC4
  Gene Name: kinesin light chain 4
  Uniprot ID: Q9NSK0
  ENST ID: ENST00000259708
  CDS Start-End: 354-2267
agacgacctgccccgccccctgcgccaccgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctt

SEQ ID NO: 146886 - DNA, 2404 bp, Homo sapiens
  Payload ID: 9055
  Gene Symbol: KLC4
  Gene Name: kinesin light chain 4
  Uniprot ID: Q9NSK0
  ENST ID: ENST00000347162
  CDS Start-End: 118-1977
agacccgtcaaaacaattgcctcgagcggcagccatcatggatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttctgtg

SEQ ID NO: 146887 - DNA, 2770 bp, Homo sapiens
  Payload ID: 9055
  Gene Symbol: KLC4
  Gene Name: kinesin light chain 4
  Uniprot ID: Q9NSK0
  ENST ID: ENST00000394056
  CDS Start-End: 496-2355
agtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctggcagatcctctgactctctggctgcagaacagtttcttccgtgctctggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggt

SEQ ID NO: 146888 - DNA, 1945 bp, Homo sapiens
  Payload ID: 9055
  Gene Symbol: KLC4
  Gene Name: kinesin light chain 4
  Uniprot ID: Q9NSK0
  ENST ID: ENST00000453940
  CDS Start-End: 81-1709
atggatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgagg

SEQ ID NO: 146889 - DNA, 1251 bp, Homo sapiens
  Payload ID: 9055
  Gene Symbol: KLC4
  Gene Name: kinesin light chain 4
  Uniprot ID: Q9NSK0
  ENST ID: ENST00000458460
  CDS Start-End: 59-1006
ggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtcagtattccttgccctccccaccccacgccccgcaccccccaccattgctgttttggcctctcttagctcatccatctgctgccctcagtccactcactaagggtgctgaggaaggaggcataagaagtcctttcttccaggcactgtccagtgatcctaatgattctcaattctctgagactcagtgactcctttttataacaaatattttgcttgaatttaattaatagataagtcataggtaaatccacatatgatttctacaaaacttaatatgctactctaataaatataaaagaaaaacaagaaaa

SEQ ID NO: 146890 - DNA, 765 bp, Homo sapiens
  Payload ID: 9055
  Gene Symbol: KLC4
  Gene Name: kinesin light chain 4
  ENST ID: ENST00000469987
  CDS Start-End: 1-478
tgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaccccacagtgaacactactctgagaaacctgggagctctgtataggcgccagggaaagctggaggctgctgagaccctggaggaatgtgccctgcggtcccggagacagtggctgatggtgaaaaaaatttgaaagccccatcctgaggagttaaggagtaggaagtcccaggtccttccttttccttccagggcactgaccctatcagccagacgaaggtggcagagctgcttggggagagtgatggtagaaggacctcccaggagggccctggagacagtgtgaaattcgagggaggtgaagatgcttctgtggctgtggagtggtccgg

SEQ ID NO: 146891 - DNA, 872 bp, Homo sapiens
  Payload ID: 9055
  Gene Symbol: KLC4
  Gene Name: kinesin light chain 4
  ENST ID: ENST00000470728
  CDS Start-End: 60-872
cggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgct

SEQ ID NO: 146892 - DNA, 2602 bp, Homo sapiens
  Payload ID: 9055
  Gene Symbol: KLC4
  Gene Name: kinesin light chain 4
  Uniprot ID: Q9NSK0
  ENST ID: ENST00000479388
  CDS Start-End: 326-2185
accgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaa

SEQ ID NO: 146893 - DNA, 1465 bp, Homo sapiens
  Payload ID: 9055
  Gene Symbol: KLC4
  Gene Name: kinesin light chain 4
  ENST ID: ENST00000481499
  CDS Start-End: 321-458
gactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctgtaggtctctggttaagtctctctctctcattcccttcctgggagacagtagctccctaggcctgcaatgagggaggctggcttggggaaggagacgggaattgggcgtctttgaagacctgtgggcagagggagggagggagggtgtttgtcctgggtggggctctgggccaggtcctctgggtagctgtgaagtggtgaaagaaggggtgggaacgctggacttctggactttgggcagggcagatcctctgactctctggctgcagaacagtttcttccgtgctctggcctgagtgccacagccagggcctctgctctgtacacagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctgg

SEQ ID NO: 146894 - DNA, 3604 bp, Homo sapiens
  Payload ID: 9055
  Gene Symbol: KLC4
  Gene Name: kinesin light chain 4
  Uniprot ID: Q9NSK0
  ENST ID: ENST00000467906
  CDS Start-End: 1352-1747
agtgtgggcaccagtgtggcccagcctcccactccaaggctccagcctgcctctatcccagacttccaggcccatgagctggctctgccaccatcatcctgcctcccgccagctcccgctccttaggtccacactcactggtaataatgctcaaaagtggtggctatctccaagccggagaaaatcaggacagcttgcaggcattgctgcagctgtgccagcctctccatttcctgggctccaccgatccggctgccctggatctgctggtcaatgtgccgggcgaactgctcactcacctgagcaatggcagagcacaggaaagccatgaatgagcgagcagagcaggcctgctcctgcccacctgcttctccaccacggcccgccaacagcgcgtcaggtttctcatgatgctgcttggaaggccccgggtagccaaggagctccagtcgtggcttctgtttctgccttctgtagagaccaagaaagtggcagaggcaaggagggtgcagcccctccactcccaagtccccatccaagggggttccctgaggcctttcctgacatgctgccacccaaaatgatgttcatggatggaggtgacacaaacctggaagatgaacaggctgagcccatagggaggggaaggatggggatggacagaagcctgtggtgtacacatggggcccaggaaaacgctcctgactagagctccccacctgaatctccactactcactgggccgaggagtggccaccacaggagggggtgcctcacagggctcgacatgcaccagcaggcactcgaaacgttattactgaaacctgcacaaccggtgatctgcaaagcactttcaccttaagtatctcgtctgaagaatttcgccctatgagaaagcaacacttgtagaggaaaaagctgaggctaagtgtgccttatccaaggtcacggacctgcatgactcctgaccagactcgcaactcccgcctcgcatgcccgcagaccccatctccggcagcccgaatggaagcagccttcttcccggccaagctgctcggtgctcctagatgacgttgactgtccggcgccgtcgctccgcaataacgtaaaaggaggcgggcagaaaactggagcccaagctggatacacacctcctttcctacctgaacgccgtgagagccaatccgcgggcagctctaatgtcgcgtgactaggaaacaggccccgcccccccagacccgtcaaaacaattgcctcgagcggcagccatcatggatttaaaggggcagtaccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccagaatctggagctcaggggatgtgcccacctaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggt

SEQ ID NO: 146895 - DNA, 577 bp, Homo sapiens
  Payload ID: 9055
  Gene Symbol: KLC4
  Gene Name: kinesin light chain 4
  ENST ID: ENST00000472792
  CDS Start-End: 330-577
accgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgag

SEQ ID NO: 146896 - DNA, 549 bp, Homo sapiens
  Payload ID: 9055
  Gene Symbol: KLC4
  Gene Name: kinesin light chain 4
  ENST ID: ENST00000481888
  CDS Start-End: 275-549
agcacctttgttcctactatagtcttcctttatttaagtcagttcatctccctctcgctttgcccacaaccttagctttgagtttagtgatctaagctccctgcctgctggtcactctctctctccagctaagccacagggtcactcttacttttgtcccttcacttggattcccaccactctctgagaaagttgctcagcttctctgtctcatctttacaccagctgaactctgttgtttctccctagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagc

SEQ ID NO: 146897 - DNA, 528 bp, Homo sapiens
  Payload ID: 9055
  Gene Symbol: KLC4
  Gene Name: kinesin light chain 4
  ENST ID: ENST00000479632
  CDS Start-End: 43-528
agtaccggcaagagcggcagccacaccggcagattgcaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccac

SEQ ID NO: 146898 - DNA, 550 bp, Homo sapiens
  Payload ID: 9055
  Gene Symbol: KLC4
  Gene Name: kinesin light chain 4
  ENST ID: ENST00000460283
  CDS Start-End: 299-550
actgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacgaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgag

SEQ ID NO: 146899 - DNA, 2957 bp, Homo sapiens
  Payload ID: 9056
  Gene Symbol: KIFAP3
  Gene Name: kinesin-associated protein 3
  Uniprot ID: Q92845
  ENST ID: ENST00000361580
  CDS Start-End: 229-2607
aggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 146900 - DNA, 4111 bp, Homo sapiens
  Payload ID: 9056
  Gene Symbol: KIFAP3
  Gene Name: kinesin-associated protein 3
  Uniprot ID: Q92845
  ENST ID: ENST00000367765
  CDS Start-End: 1503-3761
attctttttctagtctctgttgctgctttttattatttccttctgctagcttggggttttgtttgctcttctttttctagccccttaaggtgtaaaattaggttattaattcaaaatcttttatttatttttttaaatagagcgtcagtatagagtgtcttattgtggatctgtttgagtttatctttgaatttcattgagcttcttggatgtgtaagtttgtctttggtctaatttgggaagtttttgactgttttttctcccagtattctctatgtttctttcttcctctcctttcataccctcattatgcatatgttggtatactagatggtgttccataagtctcttaggttctgtttatttttcttcattctgttttctttctgtgcctcaaaatggacagtttcatttgacatatcttcaagtttgctgattcttttctctctctgctcagatctgctgttaaaaaccctgtagtgatttttttatttcagttattgtacttttcagatctagtgtttttgtttggatccttatgataatatatttttaaactatttatgtgttgagacattgtgtttctcctttttcttagttatttgcactggtttctttttgctctttggacatatttaagacagttgatttaaagtctttgataagtccagtgtttgtgctgtagcatggacagtttctgttaattttttttattgtgagaatgagaatgagtttcttgtttctttgcatgtttcatattttgttttgttgaaaactgggtattttgaatattatggtatccaaaggaaaaaaagaaaagaaaaaaatactcttcagatctttgtaggttgactcagtgtttggatatggcttcaacacttagccaggcaatttacaattttaccttagccttcatttgctgcttgcacagagcctgaagaccagccagaggtaaaagcttatgatcttcccaggttttttctgggtatgtattctgccctgagcatgctcatggatttctagatttctctttatatgcaatagcttttcaaagcatctattcccccaaaatgtctgactccctggactttcctcttgggctttcagcttgtgttttgtttgacccagctattactatttatcccaggggccagcagcttgtatgcttggctttcactgatttcagtgactgcatagctgcactatcctgataagagtttaaaattagtcaaaacaaaggaaagccccttgcagctgacctcaaaggaaacttcagtcagttgcaaaacaatcagacaaaattccttgggagcaaggtccacttgactcctctagaaccaagtattaacagtgggaacgtgggctgccatcttgaagactgccactgtgcttgagagtggggtggatgtctagggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 146901 - DNA, 2718 bp, Homo sapiens
  Payload ID: 9056
  Gene Symbol: KIFAP3
  Gene Name: kinesin-associated protein 3
  Uniprot ID: Q92845
  ENST ID: ENST00000367767
  CDS Start-End: 122-2368
ttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaagcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatgaataa

SEQ ID NO: 146902 - DNA, 3159 bp, Homo sapiens
  Payload ID: 9056
  Gene Symbol: KIFAP3
  Gene Name: kinesin-associated protein 3
  Uniprot ID: Q92845
  ENST ID: ENST00000538366
  CDS Start-End: 670-2814
caagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaagattgggaagggtcagcaggacttctgaagagggaacacgacctttaaggaggccaacagatcaggagaaggcaaaagggatgtcgattgcccttggcaacacttaccggagaagtctttcagattcagaaactgtttctgtactccaagcaagcttatgtgaagagaaaaaagaaaaatcaagcaagcctaaagatccacctccttttgaaggaatggagattgatgaagttgctaacattaatgacatggatgaatatattgagttattatatgaagatattcctgacaaagttcggggttctgctttgatcctgcagcttgctcgaaatcctgataacttggaagaactactattgaatgaaactgcccttggtgcattagcaagggtcctgagagaagactggaagcaaagtgtcgagttagctacaaacataatttacatctttttttgtttctccagcttttctcaatttcatggacttattactcactataaaattggagctctgtgtatgaatattattgatcatgagttaaaaagacatgagctttggcaagaagaactctcaaagaagaagaaagctgttgatgaagaccctgaaaaccaaaccttgagaaaggattatgaaaaaacctttaaaaagtaccaggggcttgtggtaaaacaggaacagctattacgagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgaaaatgataccttgtgagcatgaagacctgctgaatatcaccctccgacttttactaaacctatcctttgacacaggactgaggaataagatggtacaagttggactgcttcccaagctcactgcactcctaggcaatgacaactacaaacaaatagcaatgtgtgttctttaccacataagcatggatgaccgctttaaatcaatgtttgcatacactgactgtataccacagttaatgaagatgctgtttgaatgttcagatgaacgaattgacttggaactcatttctttctgcattaatcttgctgctaacaaaagaaatgtacagcttatctgtgaaggaaatgggctgaagatgctcatgaagagggctctgaagtttaaggatccattgctgatgaaaatgattagaaacatttctcagcatgatggaccaactaaaaatctgtttattgattatgttggggaccttgcagcccagatctctaatgatgaagaagaggagtttgtgattgaatgtttgggaactcttgcaaacttgaccattccagacttagactgggaattggttcttaaagaatataagttggttccatacctcaaggataaactaaaaccaggtgctgcagaagatgatcttgttttagaagtggttataatgattggaactgtatccatggatgactcttgtgctgcattgctagccaaatctggcataatccctgcactcattgaattgctaaatgctcaacaagaagatgatgaatttgtgtgtcagataatttatgtcttctaccagatggttttccaccaagccacaagagacgtcataatcaaggaaacacaggctccagcatatctcatagacctaatgcatgataagaataatgaaatccgaaaggtctgtgataatacattagatattatagcggaatatgatgaagaatgggctaagaaaattcagagtgaaaagtttcgctggcataactctcagtggctggagatggtagagagtcgtcagatggatgagagtgagcagtacttgtatggtgatgatcgaattgagccatacattcatgaaggagatattctcgaaagacctgaccttttctacaactcagatggattaattgcctctgaaggagccataagtcccgatttcttcaatgattaccaccttcaaaatggagatgttgttgggcagcattcatttcctggcagccttggaatggatggctttggccaaccagttggcattcttggacgccctgccacagcatatggattccgccctgatgaaccttactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagccacaaaactgaatgctgaaaagctactagactggaaaacaaacactgcattatgtatgttaagtgactaatttaatttcaattaaaaagcgtaaagtgaaaatg

SEQ ID NO: 146903 - DNA, 6975 bp, Homo sapiens
  Payload ID: 9057
  Gene Symbol: KNTC1
  Gene Name: kinetochore associated 1
  Uniprot ID: P50748
  ENST ID: ENST00000333479
  CDS Start-End: 178-6807
caatttaagcctgtggcatggaacctaaagactagaggcggttgtgtgagtcaggaagaggggccagatatctgagtgttcctctttagtttcttcaattgcagataatatggtgtctaattttatgttgttcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagttacaaggacaaatcaagtccagttttatttctactgaaaattatcatactcttggttgtctcagtcttgtggctggagatttagcaagtgaagttcctgtgataattgggggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacctcatatttgatgccgtgctcaagatcatgtatgcggcagtggttccttggagtgcagctgtggagcaactggtgaaacagcacctggaaatggaccatcccaaagtcaagttattacaggaaagttacaaactaatggagatgaaaaaacttttacgaggctatggaataagagaggtaaatctcttaaacaaggaaataatgagagtggttagatacattctcaaacaagatgtcccatcttctttagaagatgctttaaaggtagcccaagcgtttatgttatctgatgatgagatctacagtctaagaattattgacctgattgatagagaacagggtgaagactgtctccttctgttgaagtctttgcctcctgctgaagctgagaaaactgcagaaagagtcatcatatgggcacgactggcattacaagaagagccagatcattctaaagagggcaaggcctggagaatgtctgtagcgaagacatccgtggacattcttaagatactatgtgacattcagaaagacaatctgcagaagaaggacgaatgtgaagaaatgttgaaactatttaaagaggttgctagcttacaggagaactttgaggtctttctttcatttgaagattatagcaatagttccctggtagcagatctccgtgagcagcacattaaagctcacgaagttgcacaggcgaaacacaaacctgggagcaccccagagcccatagctgctgaggtgaggagcccaagcatggaatcaaagctgcacagacaggcactggccctgcagatgtccaaacaagagctggaggcagagctgaccttgagagccttaaaagatgggaacatcaaaacagcactgaaaaaatgcagcgacttgtttaagtatcactgcaatgctgacactgggaaattgctatttctgacatgtcagaagctttgtcagatgttggctgataatgtcccagtgacagtgcctgtgggactgaatcttccttccatgatacatgatctagcaagccaagctgccaccatttgcagtccagattttttactagatgctttagaactatgtaaacatactttaatggctgtagagctttccagacaatgccaaatggatgactgtggaatcctcatgaaagcttcttttgggacacataaagatccatatgaagagtggtcttacagtgacttcttcagtgaagatggaattgttcttgagtcacagatggtgcttccagtgatttatgaactgatttcatctcttgtgcctctagctgaaagcaagagatatcccttggagtctaccagtttgccatactgctcccttaatgaaggagatggccttgttttacctgttataaattccatctctgccctgcttcagaatcttcaggaatctagccagtgggagctagccctaagatttgtggttggttcatttggtacctgtcttcagcactctgtgtcaaacttcatgaatgccactttgagtgaaaagttatttggagagactacattagttaaatcaaggcatgttgttatggaattgaaagaaaaagctgttatatttatcagggaaaatgctacaacactactgcacaaagtatttaattgtcgcttggtagatcttgacctggcgttgggttactgcactctcttacctcaaaaagatgtgtttgaaaatctctggaagctcatagataaagcatggcagaattacgacaaaatcttggcaatatctctggtgggctctgagctggcaagtctctatcaggaaatagaaatggggcttaagttccgtgaactcagtactgatgcccagtggggcattcgtcttggtaaacttggtatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataaccaatattaatattaatcaggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaa

SEQ ID NO: 146904 - DNA, 1250 bp, Homo sapiens
  Payload ID: 9057
  Gene Symbol: KNTC1
  Gene Name: kinetochore associated 1
  ENST ID: ENST00000423927
  CDS Start-End: 939-1250
accacgcccggctaattttttgtattttagtagagacagggtttcactgtattggccaggatggtctcccatctcttgacctcgtgatccgcccacgtcggcctcccaaagtgctgggattacagacatgagctaccgcgcccagccttgagctttatttttgacattgtaaaagaacagacaagcaggcagggcgcaatcttgtctttgacaggatctcattctgtcacccaggctggagtgcagtggcattatcatggctcactgcagccttgacctctagggcctaagtgatcctcccagcttagcctcctgagtagctgggactacaggcatgcaccaccatgcccagctaattgttttgtatttttttgtagagacaaggtttccatgttggccaagctggtctcaaactcctgacctcaagtgatccacccgcctcagcctcccacagtgctgggattataggcatgagccaaaaccctgttttctttaccaaaaatataagacattttatttgccaacagttgacttatcagaaaggtaatcagtacagaaatgctatatgttttgaagcttaattcttctgcagtaatggaactggtgttctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcagcacatttcagttggactgcgatgcagttcttcagctcttcattgaaacgctgctccacaacacaaatgccggccaaggccagggagatgcaagcatggactctgcaaagcggcggcatcccaaactcctggccaaagcccttgagatggttcctttactgacgagcacaaaagatttggtcatcagtcttagtggaatactacataagttggatccttatgactatgaaatgattgaagttgtcttgaaagttatagaacgagctgatgaaaagataacc

SEQ ID NO: 146905 - DNA, 3655 bp, Homo sapiens
  Payload ID: 9057
  Gene Symbol: KNTC1
  Gene Name: kinetochore associated 1
  ENST ID: ENST00000450485
  CDS Start-End: 147-3551
caatttaagcctgtggcatggaacctaaagactagaggcggttgtgtgagtcaggaagaggggccagatatctgagtgttcctctttagtttcttcaattgcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttctgaaaaggcctcattaaatccaaagatacaggcatgcagcttaagtgatgggtttattattgtagccgaccaatcagtgatattgcttgacagtatttgtagatcacttcaattgcatcttgtctttgatactgaagtggatgtagttggcctttgtcaagaaggaaagtttcttttggttggcgagagaagtggcaacctacatcttattcatgtaacatcaaaacaaacactactcactaatgcatttgttcagaaagctaacgatgaaaatcggcggacttaccagaatcttgtcattgagaaggatggttcaaatgaaggtacctattatatgctacttcttacatacagtggatttttttgtattacaaaccttcagcttttaaaaattcaacaagcaattgagaatgtagacttcagtacagcaaaaaagggaaccggtaattgtgcattctcaaaatgggaaccagattcttccaagaaaggaatgacagttaagaaccttattgatgcagagattattaaaggtgcaaagaagttccagctgatagacaatctactttttgttcttgatactgataacgtgctgagtttatgggatatttacactctaactcctgtatggaactggccctctcttcacgtagaagagtttcttcttactacagaagcagactctccttcatcagtcacgtggcaaggaattacaaatctcaaattaatagctctgacagcttcagctaataagaagatgaaaaacctcatggtttattcattacctacaatggaaatactatattctttggaagtatctagtgtttcttctctggtccaaacaggaattagcacagataccatataccttttagaaggagtttgcaaaaatgatccaaaattgtctgaagactcagtctctgtgttagtactcagatgtcttacggaagctttaccagaaaacagattgagtcggttacttcacaaacacagatttgctgaagctgagagttttgccattcagtttggactagatgttgagcttgtttacaaggtcaagtcaaatcatatattggagaaactggcattgagttctgtggatgccagtgaacagaccgaatggcaacaacttgtagacgacgctaaggaaaatctacataagatccaggatgatgaatttgtggtgaattactgcctgaaagctcagtggataacctatgaaaccactcaagagatgctgaattatgccaaaaccaggcttttgaagaaagaagataaaactgctctcatttattctgatggcttgaaagaggtgctaagagctcatgcaaaattgactactttttatggagcatttggaccagaaaaattcagtggcagttcttggattgaatttctaaataatgaagatgatcttaaagatatttttttacagctaaaagaaggaaaccttgtttgtgcacagtatctttggcttcgacatcgggcaaactttgaaagcagatttgatgtgaaaatgctggagagcttgctcaactcaatgtctgcatcagtctctttgcaaaagctgtgtccatggtttaaaaatgatgtgattccatttgtaagaaggactgtgcctgaaggacagataattcttgcaaaatggttggaacaagcagccaggaaccttgaattaactgataaggcaaattggccagaaaatggacttcaattggcagagatattttttacagcagaaaaaacagacgagttgggattggcatcttcctggcattggatttccttgaaagattatcagaacacagaggaagtatgtcagctaaggactttggtaaataacttgcgagagttgatcacgttgcataggaagtacaactgcaaattagccctctctgattttgagaaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggatttactgaatagatgcagctcaaagtccacatcactctttgaaacagcatgggaagcaaaggccatggcagtaatagcgtgtttatctgacacggacaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagcta

SEQ ID NO: 146906 - DNA, 2412 bp, Homo sapiens
  Payload ID: 9057
  Gene Symbol: KNTC1
  Gene Name: kinetochore associated 1
  ENST ID: ENST00000436959
  CDS Start-End: 1852-2244
tatagtttagatgaataatgttaaagagaatactagaaaaggttttgatcctctttctgaaaacaagatggtctcaggaatggaaacttttgatggtatactattagatgattttatgacagtttaggattgggttactcttactggacaaaagttttttattttaatataggcattgagtattctgaaacatttgaagtcatacagaagaatttctcctcccgtggatctagaatatcagtatatgttggaacatgtcataactttgccatcagctgcccaaactagactgccttttcacctgatattctttggcacagcacagaacttctggaaaattctctctacagaactcagtgaagaatctttcccaacattgctcttaatttcgaaattaatgaagttctctctggacactctgtacgtgtctacagcaaaacacgttttcgaaaaaaaactgaagccaaagctcctgaagttaacacaagctaaatcctcaacactgattaacaaggaaataactaagatcacgcagaccatcgaatcctgcttactctctatagtcaacccagagtgggctgtagctattgccatcagccttgcccaggatatccctgaaggttccttcaagatatctgctttgaaattctgcctttatttagctgagagatggctacagaatatcccatcgcaggacgaaaaacgtgaaaaagccgaggctttgttgaagaagcttcatatccagtaccggcgatcgggcacagaagctgtgctcatagcccacaagctgaacactgaggaatatttaagagtgatcggaaagccagcacatcttattgtcagtctctacgaacatcctagcatcaatcaaagaattcagaattcatctggcacagattatcctgatattcatgcagcagctaaagaaatagccgaagtcaatgaaattaatttggaaaaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaaatcttatttgagatgtataacttttctggcatcatttgagactttgaatatccccatcacatatgaattattttgcagcagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcagagatggaggtcttgctatgttgcctaggctggtcttagaactcctgagctgaaacaatcctcctgccttggcctcccaaagtactgggattacaggttccctacttcagcaaagcgtggcagcgtgtgatacagataccactgctttcagcctcttgtcctttaagtcctgatcagctgtcagattgttctgagagtctcatcgctgtcctcgaatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatgagcataattgccccataaagaa

SEQ ID NO: 146907 - DNA, 1065 bp, Homo sapiens
  Payload ID: 9057
  Gene Symbol: KNTC1
  Gene Name: kinetochore associated 1
  ENST ID: ENST00000534995
  CDS Start-End: 526-918
gcctgtaatcccagctactcaggaagctgaggagggagaatcacttgaacccgggaggtgttggttgcagtgagctaagatcatgccatcgtactccagcctgggtgacagagctagactgtttctcaaaaaaaaaaaaaaaaaaggttttgagtcttctgagaatttagaagcctatctttaggcatctgtaggctttcagacataatcatgatagcaaacagtagtccgtgttcccatgggtaaattcttttattctgtgtagagtgctgtcaaagacttgtgttactcattcctaagcatatgtcatgcaccagcactttagtgtttaaaattattgaaaacttggacaggcagatgactatggaaagctagaaaggccaatataatctagtgaatctgccagattattaactaattaatgttctctctcgaagatgtccagtctcaggtgatcttgacctgatcggagtcgccaggcagtatatccagttagaacttccggcttttgcattagcttgtctgatgctcatgccccactcagagaaaagacaccagcaaattaagaattttctgggttcctgtgaccctcaggttattttaaagcaattggaagagcatatgaacacgggccagctagcaggattttcacatcaaattagaagtctgattttgaataatatcatcaataagaaggagtttgggattttggcaaagaccaaatactttcaaatgttgaagatgcatgcgatgaataccaacaatatcactgagctagtgaactatttggcaaatgacttaagtttagatgaagcttcagtcttgataactgaatattcaaagcactgcgggaaacctgtgcctccagacactgctccctgtgaaattctgaagatgtttcttagtggattatcgtaaatcactgaacctttttttcaagaaggacaagaattttggagtctgctattaatggaccatatttattacagtttttaaattgtacaatctctgtattatagctatttgtctaacattaccccacatgtaataaataaaacaatatga

SEQ ID NO: 146908 - DNA, 624 bp, Homo sapiens
  Payload ID: 9057
  Gene Symbol: KNTC1
  Gene Name: kinetochore associated 1
  ENST ID: ENST00000546125
  CDS Start-End: 1-624
aaagtctgggacatgttgttggaaaaatggctatgcccttcaacaaaacctggtgaaaaaccatcagaattatttgaacttcaagaagatgaagccctacgaagagtgcagtatctcctcctgtctcgtccaattgattatagttcaagaatgctgtttgtatttgcaacatcaactacaaccacattaggtatgcatcagttaacttttgcccatagaactcgagctcttcagtgtctcttctatttggctgacaaggaaactatagaatctctctttaaaaaacccattgaagaagtgaacagtcctaaagaaggaatgattaagggtctgtggaaaaaccacagccacgagtccatggcagtaagattggtgactgagctgtgtttagaatacaaaatctatgacctgcagctttggaatggactcttgcaaaagcttctgggcttcaatatgattccttatctaaggaaagttttaaaagccatctccagtatccattctttatggcaggttccctacttcagcaaagcgtggcagcgtgtgatacagataccactgctttcagcctcttgtcctttaagtcctgatcagctgtcagattgttctgagagtctcatcgct

SEQ ID NO: 146909 - DNA, 1714 bp, Homo sapiens
  Payload ID: 9058
  Gene Symbol: KNSTRN
  Gene Name: kinetochore-localized astrin/SPAG5 binding protein
  Uniprot ID: Q9Y448
  ENST ID: ENST00000249776
  CDS Start-End: 116-1066
attagctccattcaagcctacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 146910 - DNA, 1899 bp, Homo sapiens
  Payload ID: 9058
  Gene Symbol: KNSTRN
  Gene Name: kinetochore-localized astrin/SPAG5 binding protein
  Uniprot ID: Q9Y448
  ENST ID: ENST00000416151
  CDS Start-End: 116-976
attagctccattcaagcctacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacagattgcttggatgaatcatgggatattgcaccaaatgtagaggatttcatcgttccagtttagatacaggagtctagtccctctctactactagagggacaattcctaaaaccagtgcatagaaataaaatctaaaatagaagatacagtctgttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagta

SEQ ID NO: 146911 - DNA, 1464 bp, Homo sapiens
  Payload ID: 9058
  Gene Symbol: KNSTRN
  Gene Name: kinetochore-localized astrin/SPAG5 binding protein
  Uniprot ID: Q9Y448
  ENST ID: ENST00000448395
  CDS Start-End: 1-726
atggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaat

SEQ ID NO: 146912 - DNA, 664 bp, Homo sapiens
  Payload ID: 9058
  Gene Symbol: KNSTRN
  Gene Name: kinetochore-localized astrin/SPAG5 binding protein
  ENST ID: ENST00000559304
  CDS Start-End: 1-195
gttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagtacaactattattacagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatg

SEQ ID NO: 146913 - DNA, 1388 bp, Homo sapiens
  Payload ID: 9058
  Gene Symbol: KNSTRN
  Gene Name: kinetochore-localized astrin/SPAG5 binding protein
  ENST ID: ENST00000561169
  CDS Start-End: 1-373
agttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggtacaactattattacagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacct

SEQ ID NO: 146914 - DNA, 940 bp, Homo sapiens
  Payload ID: 9058
  Gene Symbol: KNSTRN
  Gene Name: kinetochore-localized astrin/SPAG5 binding protein
  ENST ID: ENST00000560321
  CDS Start-End: 1-386
tatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaagggtgagcatcaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatga

SEQ ID NO: 146915 - DNA, 1598 bp, Homo sapiens
  Payload ID: 9058
  Gene Symbol: KNSTRN
  Gene Name: kinetochore-localized astrin/SPAG5 binding protein
  ENST ID: ENST00000560981
  CDS Start-End: 116-496
attagctccattcaagcctacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaat

SEQ ID NO: 146916 - DNA, 651 bp, Homo sapiens
  Payload ID: 9058
  Gene Symbol: KNSTRN
  Gene Name: kinetochore-localized astrin/SPAG5 binding protein
  ENST ID: ENST00000557920
  CDS Start-End: 1-651
ttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggacggagttttgctcttgttgccacccaggctggagtgcaatggcgcaatctcagctcaccacaacctccgcctcctgggttcaagcgattatcctgcctcagcctcccaaatacctgggattacagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccag

SEQ ID NO: 146917 - DNA, 405 bp, Homo sapiens
  Payload ID: 9058
  Gene Symbol: KNSTRN
  Gene Name: kinetochore-localized astrin/SPAG5 binding protein
  ENST ID: ENST00000559083
  CDS Start-End: 1-82
gaccagtgtggttaagacagtgtatagcctgcagcccccctctgcgctgagcggcggccagccggcagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacag

SEQ ID NO: 146918 - DNA, 903 bp, Homo sapiens
  Payload ID: 9058
  Gene Symbol: KNSTRN
  Gene Name: kinetochore-localized astrin/SPAG5 binding protein
  ENST ID: ENST00000560220
  CDS Start-End: 1-202
gacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagaacacctgaatggtaatcctggcaccagcggggactaggagttgctggaagaactggagccagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctc

SEQ ID NO: 146919 - DNA, 1495 bp, Homo sapiens
  Payload ID: 9058
  Gene Symbol: KNSTRN
  Gene Name: kinetochore-localized astrin/SPAG5 binding protein
  ENST ID: ENST00000608100
  CDS Start-End: 130-846
tttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatat

SEQ ID NO: 146920 - DNA, 3435 bp, Homo sapiens
  Payload ID: 9059
  Gene Symbol: KNG1
  Gene Name: kininogen 1
  Uniprot ID: P01042
  ENST ID: ENST00000265023
  CDS Start-End: 213-2147
aaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccatacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaa

SEQ ID NO: 146921 - DNA, 1720 bp, Homo sapiens
  Payload ID: 9059
  Gene Symbol: KNG1
  Gene Name: kininogen 1
  Uniprot ID: P01042
  ENST ID: ENST00000287611
  CDS Start-End: 268-1551
ttttcaaatgcaaatgagcaggttaacaaccccagtgttgcaatgttctagctgtaaatatgtttggataacccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaa

SEQ ID NO: 146922 - DNA, 1391 bp, Homo sapiens
  Payload ID: 9059
  Gene Symbol: KNG1
  Gene Name: kininogen 1
  Uniprot ID: P01042
  ENST ID: ENST00000447445
  CDS Start-End: 196-1371
ccagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcac

SEQ ID NO: 146923 - DNA, 608 bp, Homo sapiens
  Payload ID: 9060
  Gene Symbol: KNCN
  Gene Name: kinocilin
  Uniprot ID: A6PVL3
  ENST ID: ENST00000396314
  CDS Start-End: 1-306
atggacatccccatcagcagcagagacttccgcggcctgcagctggcctgcgtggctctcgggctggtggctggcagcatcattatcggcatctccgtatccaaggctgcagctgccatgggcggtgtctttattggcgctgctgttctggggagcctaagaatccatccccatccaggggcagaccacggggaaggaagatccagcaccaatggcaacaaggaaggagcccgcagcagcctgtccaccgtgagcaggaccctggagaagctgaagccggggacccggggggctgaggaatgctgaggcaaagtctgagcggctgcccatgccctgccctcccatcctgcctgctgcccctatgtcagtgccctcctgggttaggagacccggaccggagacaagccaggccctgcagaccccagagcggctgggaacagtgtctggaatggggccttttgcactcgcccggccaagcctctccaaaatggattccactggtgtgggctgggacctggagcaaggtgtcgccggacgcccccacagggttcccatgtttcaggctcctgccctggcctttctttctggactgcagctcagctttgttg

SEQ ID NO: 146924 - DNA, 1037 bp, Homo sapiens
  Payload ID: 9060
  Gene Symbol: KNCN
  Gene Name: kinocilin
  Uniprot ID: A6PVL3
  ENST ID: ENST00000481882
  CDS Start-End: 313-687
gccaaagcagaaatgtagccagacaggagtcccaagggtgggcttcagcttcagagggctttgagagaggaagagtaagctgggtgacctcgtacagatccctggtcaaggtgggactggggggcccgtagtggagcagtggaataggactgcagataaatcccagggttccccacctatcatcttactgcccagaaactcctaccctgaagttggagcgccaacaaggagacatccaagagcccagaaacttccaggacttttctggggccagactgcaccggctggaggcagtgccccgggtgggcctgcatggacatccccatcagcagcagagacttccgcggcctgcagctggcctgcgtggctctcgggctggtggctggcagcatcattatcggcatctccgtatccaaggctgcagctgccatgggcggtgtctttattggcgctgctgttctggggctcctcatcttggcctaccccttcctgaaggctcggttcaacctggaccacatcctgcctaccatagggagcctaagaatccatccccatccaggggcagaccacggggaaggaagatccagcaccaatggcaacaaggaaggagcccgcagcagcctgtccaccgtgagcaggaccctggagaagctgaagccggggacccggggggctgaggaatgctgaggcaaagtctgagcggctgcccatgccctgccctcccatcctgcctgctgcccctatgtcagtgccctcctgggttaggagacccggaccggagacaagccaggccctgcagaccccagagcggctgggaacagtgtctggaatggggccttttgcactcgcccggccaagcctctccaaaatggattccactggtgtgggctgggacctggagcaaggtgtcgccggacgcccccacagggttcccatgtttcaggctcctgccctggcctttctttctggactgcagctcagctttgttgcctgttcaatctactgatttgtttctctggaatttggggtccaaggcc

SEQ ID NO: 146925 - DNA, 1119 bp, Homo sapiens
  Payload ID: 9061
  Gene Symbol: KRAS
  Gene Name: Kirsten rat sarcoma viral oncogene homolog
  Uniprot ID: P01116
  ENST ID: ENST00000256078
  CDS Start-End: 65-634
ctgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagagagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgt

SEQ ID NO: 146926 - DNA, 5765 bp, Homo sapiens
  Payload ID: 9061
  Gene Symbol: KRAS
  Gene Name: Kirsten rat sarcoma viral oncogene homolog
  Uniprot ID: P01116
  ENST ID: ENST00000311936
  CDS Start-End: 193-759
tcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgactatgagtgtgtatttattcatgaaatttgaactgtttgccccgaaatggatatggaatactttataagccatagacactatagtataccagtgaatcttttatgcagcttgttagaagtatcctttatttctaaaaggtgctgtggatattatgtaaaggcgtgtttgcttaaacttaaaaccatatttagaagtagatgcaaaacaaatctgcctttatgacaaaaaaataggataacattatttatttatttccttttatcaaagaaggtaattgatacacaacaggtgacttggttttaggcccaaaggtagcagcagcaacattaataatggaaataattgaatagttagttatgtatgttaatgccagtcaccagcaggctatttcaaggtcagaagtaatgactccatacatattatttatttctataactacatttaaatcattaccagg

SEQ ID NO: 146927 - DNA, 1696 bp, Homo sapiens
  Payload ID: 9061
  Gene Symbol: KRAS
  Gene Name: Kirsten rat sarcoma viral oncogene homolog
  ENST ID: ENST00000556131
  CDS Start-End: 178-309
ctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggcctgctgaaaatgactgaatataaacttgtggtagttggagctggtggcgtaggcaagagtgccttgacgatacagctaattcagaatcattttgtggacgaatatgatccaacaatagaggtgttattaagcagtatgtaaaaagtccttacaatacttaatacattaagaaaacatacaatttcaagaggaaatccccgagtaatacattattgacattttcagcagttctagttatattgagaagagcatctcatggaattggcagaatgaagatggagattaaatgagatgatgtttgtaatatgcttatgacagtatctggcatataagtaagggctcagtaaatgttgactgctgtaattactattaatagtaatatgattacctttagtaaaagttattagtttctttaggttttttgtttactacaatatagtaaacaaaatctatacttggaatgtatatattgttttgttttgatacatggaatatgtctctgtgtcagagtcactgcctgagttggaaaacccatactcgagtatgttaaaaggtgaacacactgaataatttagttattaattataatggaaaaatgacaaacttgatgttctggttaatgaggttatcttatcttgaatgagttagcttttaaattcctcaaaataaaggcatttaataaaccaggaaacacttcattaaaaaaattatgcaagtcagtgtaaaagaagattaaaattccacatgggcaaaggacacacgttggcgataaatatgcagataagaaaaaaaacctatataacattattactcctcaaagaaattggtatgaaaacaataaaaatgtgtagcttatcaaaccaacaaaaatttaaaaatatgaaatccattttaagtaatgataaaatgggtgcactcttagtgctttatagaatagtagtataatgaacctcatgtgtgtaccaaccagctctttcatatcttaacatttagcaacatttgatttagctctttcttttttccaagatagaaaagttaatattgttgaagactcctgcattcttttccctagtcttattttcttccctcccataaatgtgttaaaatctctgtgtgtattgttttggttgtatttttacataaaactttacatattatataaaatttaattgaaggtaaaatttattaaattattcttaatatatattgtaatttaaaaattaacagcttcattgtcttgataaaatttatggtatcttaaacatgtgcttgtttttctaagagaacattgaaacatagattttaaaacaaattgttgaaagattaaaaaatctgcctttgcacactgttacattgaaagtggggcatttgtcgtgaacattcatttcaaatatgtagtatcttcagaatatttgagaaggatttgtattatataattgaaaaatctgttaaattgtatttatgttaactgcttaattctaataaaatttccattcattttttagtatctgcatatatttacatcaaa

SEQ ID NO: 146928 - DNA, 1052 bp, Homo sapiens
  Payload ID: 9061
  Gene Symbol: KRAS
  Gene Name: Kirsten rat sarcoma viral oncogene homolog
  ENST ID: ENST00000557334
  CDS Start-End: 198-425
gattttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggcttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaa

SEQ ID NO: 146929 - DNA, 709 bp, Homo sapiens
  Payload ID: 9062
  Gene Symbol: KISS1
  Gene Name: KiSS-1 metastasis-suppressor
  Uniprot ID: Q15726
  ENST ID: ENST00000367194
  CDS Start-End: 150-566
ctcttgagaccgggagcccagctgcccaccctctggacattcacccagccaggtggtctcgtcacctcagaggctccgccagactcctgcccaggccaggactgaggcaagcctcaaggcacttctaggacctgcctcttctcaccaagatgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggctgagggcgcaggtgcggggcagtgaacttcagaccccaaaggagtcagagcatgcggggcgggggcggggggcggggacgtagggctaagggagggggcgctggagcttccaacccgaggcaataaaagaaatgttgcgtaactca

SEQ ID NO: 146930 - DNA, 435 bp, Homo sapiens
  Payload ID: 9062
  Gene Symbol: KISS1
  Gene Name: KiSS-1 metastasis-suppressor
  ENST ID: ENST00000625357
  CDS Start-End: 1-435
atgaactcactggtttcttggcagctactgcttttcctctgtgccacccactttggggagccattagaaaaggtggcctctgtggggaattctagacccacaggccagcagctagaatccctgggcctcctggcccccggggagcagagcctgccgtgcaccgagaggaagccagctgctactgccaggctgagccgtcgggggacctcgctgtccccgccccccgagagctccgggagcccccagcagccgggcctgtccgccccccacagccgccagatccccgcaccccagggcgcggtgctggtgcagcgggagaaggacctgccgaactacaactggaactccttcggcctgcgcttcggcaagcgggaggcggcaccagggaaccacggcagaagcgctgggcggggcggcgcaggtgcggggcagtga

SEQ ID NO: 146931 - DNA, 1625 bp, Homo sapiens
  Payload ID: 9063
  Gene Symbol: KISS1R
  Gene Name: KISS1 receptor
  Uniprot ID: Q969F8
  ENST ID: ENST00000234371
  CDS Start-End: 162-1358
gccgagcccagcacagctgccctctggaccctgcggaccccagccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggctctgcggcggtgtctgcgccggtgctcgccctgcaccgcctgtcacccgggccgcgcgcctactgcagtgaggccttccccagccgcgccctggagcgcgccttcgcactgtacaacctgctggcgctgtacctgctgccgctgctcgccacctgcgcctgctatgcggccatgctgcgccacctgggccgggtcgccgtgcgccccgcgcccgccgatagcgccctgcaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgctccgcctggggtcccacccggcccccgccagggcgcagaagccagggagcagtgggctggccgcgcgcgggctgtgcgtcctgggggaggacaacgcccctctctgagcggacccggtgggaatccgagcggctccctcgggagcggggactgctggaacagcggctattcttctgttattagtatttttcttactgtccaagatcaactgtggaaatattttggtctcttgtgacgttcggtgcagtttcgttgtgaagtttgctattgatattgaaattatgacttctgtgtttcctgaaattaaacatgtgtcaacacaggactttctggatcattccagaaagtgtcagacgttttctcattgtcttgta

SEQ ID NO: 146932 - DNA, 507 bp, Homo sapiens
  Payload ID: 9063
  Gene Symbol: KISS1R
  Gene Name: KISS1 receptor
  ENST ID: ENST00000592648
  CDS Start-End: 217-507
gggaggggggcacgggctataaacgctcggccgcagcggcgccggcagaggagccgccgagcccagcacagctgccctctggaccctgcggaccccagccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcggtctcggtgcaggccacgtgtgccactctgaccgccatgagtgtgga

SEQ ID NO: 146933 - DNA, 964 bp, Homo sapiens
  Payload ID: 9063
  Gene Symbol: KISS1R
  Gene Name: KISS1 receptor
  ENST ID: ENST00000606939
  CDS Start-End: 1-681
atgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgctccgcctggggtcccacccggcccccgccagggcgcagaagccagggagcagtgggctggccgcgcgcgggctgtgcgtcctgggggaggacaacgcccctctctga

SEQ ID NO: 146934 - DNA, 1948 bp, Homo sapiens
  Payload ID: 9064
  Gene Symbol: KITLG
  Gene Name: KIT ligand
  Uniprot ID: P21583
  ENST ID: ENST00000347404
  CDS Start-End: 574-1311
aacagagggagctccgagccctctctggcgcgcgaggtatttcgtctgtccccgggggtgccaggtgagccccagcggatccgggagggtaagctgggactcctcgcgagcagtagctgcagggtaccaagcttcgccctctgcgtccccgcgccttcgcggtctcccgccagtgcaggtccggggcccccaggcgagcggacaaggttggcctaatctgccaaacttctggggcatttaccgtgctctggccgccctcccgattcttccctccgcgcccttgcctgcttctcgcctaccccgggctccggaagggaaggaggcgtgtccggagcaggcgggcgggaactgtataaaagcgccggcggctcagcagccgggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 146935 - DNA, 1642 bp, Homo sapiens
  Payload ID: 9064
  Gene Symbol: KITLG
  Gene Name: KIT ligand
  Uniprot ID: P21583
  ENST ID: ENST00000228280
  CDS Start-End: 184-1005
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatccca

SEQ ID NO: 146936 - DNA, 565 bp, Homo sapiens
  Payload ID: 9064
  Gene Symbol: KITLG
  Gene Name: KIT ligand
  ENST ID: ENST00000357116
  CDS Start-End: 256-426
gcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctaccca

SEQ ID NO: 146937 - DNA, 555 bp, Homo sapiens
  Payload ID: 9064
  Gene Symbol: KITLG
  Gene Name: KIT ligand
  ENST ID: ENST00000552044
  CDS Start-End: 482-555
ttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaacaaagcagctgctttgaaaagaagctcaaaggattaccttgaaatggttacccactctcccccttttctgctccaagaagaaagtttctttctgtattttcccagcattattaagagtcaagacttgaggccttaagacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtaca

SEQ ID NO: 146938 - DNA, 135 bp, Homo sapiens
  Payload ID: 9064
  Gene Symbol: KITLG
  Gene Name: KIT ligand
  ENST ID: ENST00000613305
  CDS Start-End: 1-135
gaaaactcatctaagtgtttttcagtatgttgcaagagaaagagagagagtttcaagaagtgtaattgtggcttgtatcaacactgttactttcgtacattggctggtaacagttcatgtttgcttcataaatga

SEQ ID NO: 146939 - DNA, 1663 bp, Homo sapiens
  Payload ID: 9065
  Gene Symbol: KIZ
  Gene Name: kizuna centrosomal protein
  ENST ID: ENST00000619179
  CDS Start-End: 1-1617
aagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 146940 - DNA, 2014 bp, Homo sapiens
  Payload ID: 9065
  Gene Symbol: KIZ
  Gene Name: kizuna centrosomal protein
  Uniprot ID: Q2M2Z5
  ENST ID: ENST00000620891
  CDS Start-End: 256-1968
gcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 146941 - DNA, 2130 bp, Homo sapiens
  Payload ID: 9065
  Gene Symbol: KIZ
  Gene Name: kizuna centrosomal protein
  Uniprot ID: Q2M2Z5
  ENST ID: ENST00000619189
  CDS Start-End: 63-2084
ttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcagagttaagctgaaatatgtaaaactaaagaattatctgaaggaaatatgtgaatctgaaaagaaggctcatactcgaaaccaagaatatttaaagcgatttgagcgtgtccaagctcatgttgtacacttcaccacaaatacagagaagcttcaaaaactgaagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 146942 - DNA, 1875 bp, Homo sapiens
  Payload ID: 9065
  Gene Symbol: KIZ
  Gene Name: kizuna centrosomal protein
  Uniprot ID: Q2M2Z5
  ENST ID: ENST00000616848
  CDS Start-End: 211-1833
ccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagtgaaaagaagagattggacctggaaaagaaactttatgaatataatcagtctgatacatgcaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaact

SEQ ID NO: 146943 - DNA, 1397 bp, Homo sapiens
  Payload ID: 9065
  Gene Symbol: KIZ
  Gene Name: kizuna centrosomal protein
  ENST ID: ENST00000621366
  CDS Start-End: 1-1351
ctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 146944 - DNA, 408 bp, Homo sapiens
  Payload ID: 9065
  Gene Symbol: KIZ
  Gene Name: kizuna centrosomal protein
  ENST ID: ENST00000612654
  CDS Start-End: 103-288
ggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagatttccctggcgactgctgcatacttttgtgccttttgttttagatgcgtctggcattttctgcttcttagaccagagaagcattttcacaaagtgaaaagaagagattggacctggaaaagaaactttatgaatataatcagtctgatacatgcagagttaagctgaaatatgtaaaactaaagaattatctgaaggaaatatgtgaatctgaaaa

SEQ ID NO: 146945 - DNA, 3856 bp, Homo sapiens
  Payload ID: 9065
  Gene Symbol: KIZ
  Gene Name: kizuna centrosomal protein
  ENST ID: ENST00000616679
  CDS Start-End: 1-1566
aagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatggtgagagagataatcggacactagattttctttttctgttttaaccaaaaaactctgtgacatgcatttgttgtttgcaccctcatgtgagtcctgaagcgggcatgctcacagggactgccattgcagctgtccctggggtggaacctgagggcttctggaggctcagttcttcacagacaggaccacacgggtgccatggaccacaggggcagagcattgtaatttgcaagtatgaatttgcaggggatcctggcctccatgtctaattaattatcagcaccctgtattttaccaatgaaatgtttcttgcctctctcctcatcctcagaagcacccattgctcatgaccggacaggctcttggagtaactctaactggtttcctcatacccagttcctcccagctcctgggaactcccagctcctccacctggccaccagcctccaaaccctggcttcccccgaccttcctgtgtaaggacggccaatgcctccccgtaccttcagggtagagtctgagctttctccattcctgggaggccccagccctgctctccagcttattcctcccaaggtcgcctctttgggtcaagccacagtcagcttttttcagctgtagcacacctatgcctctgtacctttgcccatgttgttccttctgtagggagttccttttccttttcctcagcccagtgagctcctattcatccttcaacacccaactcacgggaaaaatctagccctcctaccataacactgtggcatatcccctgcccagcttgggctctctcacctcctgtctccttaaaccccttataccttaaattaaaggtataatttgattaatagttttactgacaataacaaaaatattcgctgtttatttagccccagtatgtcccactttgctaacccagtatggaaactgattcagagctgctgtagaacctaggcctaggaatctgcctttttagcaagcaccccactgtgaatcactcttctagaaggacagctacctactgtgggggagacaagtacccagtgggttgtgatggagagtatgggcttgagtcagatgacttggatgggactcccagcttggccactcactggcattgtgattgtggccaatttcttaacccccttcagcgtccgtttgtttgcacagtgaaatggaaacattaatacttaccttgccaggctggtgcgaggatgagatggggttgtgtatgagaagtcagcacagagctggcaggtggtgccatgcaggtgtcagcagagttaagggattgttgatgtagtagacgtggtccgctccactacaccttgccagaccacctgcagggcacctcagctccaattcacagacgcgcctacagcttcctgcaccaagcagctgtgtctctctgcctgagggctttctctggctgcaggagcgtgctcagccctcacaaggcagcccaaagtaccagggagttgatgccctgggttgagagcaaccctcaaccaacagaggcaagttggtggatcagtaaccccactcccttgctcttcactgggacaatctggggagagttctgcagtctctcagggggccccagcaggctgagccttgcctgtccactcactgccaggcacccactcgtcatcatacccttcattggcttcctgtcttccttgtgtcactgtccccatggttcctgggatcacctctcaagtaaatgatgtggaccaaagtcctgtctcagggtaaccatctctgcttattcctctgccacgtctttcccttctcctctctgctctcataaagaagaatgggagatgaaagtggaggggcagctgaggtggggcggcatcaggctgatacaacaccccagggaaccctgcttccatgtaaccctgaccttaaatccctatcctataataaagagttgggcacaacagaagggaaaaggaagtattctgcaaattgttttccataacagtgcagaggacacactttgcaatgtgtaatttgtgcagtatgacatgcatttgggtgtgtctggtcaggtacatcatgtggtgtccctgttatgcattttgcagactgacactctgcttaaccagtccttccgtgctgtgctgttttgtaagctcttaaccagaatgcaaaaatgttaaataactgtctggttttattttccagccctctgggatgagtctgatgacagtaactcagaaattgaggctgctttacgccccagaaaccataacaccgatgattctgatgatttttatgactaacgtgctgtgacattggtttcaaataaagtctttaaacaaactaaaa

SEQ ID NO: 146946 - DNA, 1915 bp, Homo sapiens
  Payload ID: 9065
  Gene Symbol: KIZ
  Gene Name: kizuna centrosomal protein
  ENST ID: ENST00000611685
  CDS Start-End: 1-1873
ggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaact

SEQ ID NO: 146947 - DNA, 1971 bp, Homo sapiens
  Payload ID: 9065
  Gene Symbol: KIZ
  Gene Name: kizuna centrosomal protein
  ENST ID: ENST00000619574
  CDS Start-End: 55-1929
ggcgtcttgccccgcctcctgcaggcggcccggcgcggtgtttacccgcggtgcatggtggggcggtctccttcggcaaccccggccgaacggccacccagaggctgtgctgagctggcgcagcggcagcagcatgagccggaccctcgcatcggccgtgcccctgtcgagtcccgactactacgagaggctgggccaactccagcacgggctgcgggacagctcgaatatgagactcaaattaagaagatgctatgctcaaaagatagcctgggactaaaagaggaactgacagatgaagacagagaaaaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggaggaggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaact

SEQ ID NO: 146948 - DNA, 5006 bp, Homo sapiens
  Payload ID: 9066
  Gene Symbol: KL
  Gene Name: klotho
  Uniprot ID: Q9UEF7
  ENST ID: ENST00000380099
  CDS Start-End: 9-3047
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggctgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaatggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcata

SEQ ID NO: 146949 - DNA, 6082 bp, Homo sapiens
  Payload ID: 9067
  Gene Symbol: KLB
  Gene Name: klotho beta
  Uniprot ID: Q86Z14
  ENST ID: ENST00000257408
  CDS Start-End: 98-3232
atcctcagtctcccagttcaagctaatcattgacagagctttacaatcacaagcttttactgaagctttgataagacagtccagcagttggtggcaaatgaagccaggctgtgcggcaggatctccagggaatgaatggattttcttcagcactgatgaaataaccacacgctataggaatacaatgtccaacgggggattgcaaagatctgtcatcctgtcagcacttattctgctacgagctgttactggattctctggagatggaagagctatatggtctaaaaatcctaattttactccggtaaatgaaagtcagctgtttctctatgacactttccctaaaaactttttctggggtattgggactggagcattgcaagtggaagggagttggaagaaggatggaaaaggaccttctatatgggatcatttcatccacacacaccttaaaaatgtcagcagcacgaatggttccagtgacagttatatttttctggaaaaagacttatcagccctggattttataggagtttctttttatcaattttcaatttcctggccaaggcttttccccgatggaatagtaacagttgccaacgcaaaaggtctgcagtactacagtactcttctggacgctctagtgcttagaaacattgaacctatagttactttataccactgggatttgcctttggcactacaagaaaaatatggggggtggaaaaatgataccataatagatatcttcaatgactatgccacatactgtttccagatgtttggggaccgtgtcaaatattggattacaattcacaacccatatctagtggcttggcatgggtatgggacaggtatgcatgcccctggagagaagggaaatttagcagctgtctacactgtgggacacaacttgatcaaggctcactcgaaagtttggcataactacaacacacatttccgcccacatcagaagggttggttatcgatcacgttgggatctcattggatcgagccaaaccggtcggaaaacacgatggatatattcaaatgtcaacaatccatggtttctgtgcttggatggtttgccaaccctatccatggggatggcgactatccagaggggatgagaaagaagttgttctccgttctacccattttctctgaagcagagaagcatgagatgagaggcacagctgatttctttgccttttcttttggacccaacaacttcaagcccctaaacaccatggctaaaatgggacaaaatgtttcacttaatttaagagaagcgctgaactggattaaactggaatacaacaaccctcgaatcttgattgctgagaatggctggttcacagacagtcgtgtgaaaacagaagacaccacggccatctacatgatgaagaatttcctcagccaggtgcttcaagcaataaggttagatgaaatacgagtgtttggttatactgcctggtctctcctggatggctttgaatggcaggatgcttacaccatccgccgaggattattttatgtggattttaacagtaaacagaaagagcggaaacctaagtcttcagcacactactacaaacagatcatacgagaaaatggtttttctttaaaagagtccacgccagatgtgcagggccagtttccctgtgacttctcctggggtgtcactgaatctgttcttaagcccgagtctgtggcttcgtccccacagttcagcgatcctcatctgtacgtgtggaacgccactggcaacagactgttgcaccgagtggaaggggtgaggctgaaaacacgacccgctcaatgcacagattttgtaaacatcaaaaaacaacttgagatgttggcaagaatgaaagtcacccactaccggtttgctctggattgggcctcggtccttcccactggcaacctgtccgcggtgaaccgacaggccctgaggtactacaggtgcgtggtcagtgaggggctgaagcttggcatctccgcgatggtcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctggtggcccacgccctggcctggcgcctctacgaccggcagttcaggccctcacagcgcggggccgtgtcgctgtcgctgcacgcggactgggcggaacccgccaacccctatgctgactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgccgcgcctcaccgaggccgaaaggaggctgctcaagggcacggtcgacttctgcgcgctcaaccacttcaccactaggttcgtgatgcacgagcagctggccggcagccgctacgactcggacagggacatccagtttctgcaggacatcacccgcctgagctcccccacgcgcctggctgtgattccctggggggtgcgcaagctgctgcggtgggtccggaggaactacggcgacatggacatttacatcaccgccagtggcatcgacgaccaggctctggaggatgaccggctccggaagtactacctagggaagtaccttcaggaggtgctgaaagcatacctgattgataaagtcagaatcaaaggctattatgcattcaaactggctgaagagaaatctaaacccagatttggattcttcacatctgattttaaagctaaatcctcaatacaattttacaacaaagtgatcagcagcaggggcttcccttttgagaacagtagttctagatgcagtcagacccaagaaaatacagagtgcactgtctgcttattccttgtgcagaagaaaccactgatattcctgggttgttgcttcttctccaccctggttctactcttatcaattgccatttttcaaaggcagaagagaagaaagttttggaaagcaaaaaacttacaacacataccattaaagaaaggcaagagagttgttagctaaactgatctgtctgcatgatagacagtttaaaaattcatcccagttccatatgctggtaacttacaggagatatacctgtattatagaaagacaatctgagatacagctgtaaccaaggtgatgacaattgtctctgctgtgtggttcaaagaacattcccttaggtgttgacatcagtgaactcagttcttggatgtaaacataaaggcttcatcctgacagtaagctatgaggattacatgctacattgcttcttaaagtttcatcaactgtattccatcattctgctttagctttcatctctaccaatagctacttgtggtacaataaattatttttaagaagtaaaactctggggctggacgctgtggctcacacctgtaatctcagcactttgggaggccgaggcggggagatcacctgaggtgaggagttcgagaccagcctggccaacatggtgaaaccatgtctctactaaaaatacaaaaaattagccaggcgtggtgacagtggcacctgtaatcccagctacttgggaggctgaggcagaagtttgaacccaggaaacaggttacagtaggccaaaattgcgccactgcactccagcctaggcgacaacagcaagactgtgtccaaaaaaaaaaaaaaaagcaaaagcaaaactttgttttgttagactctacagcagagatttaacacccttctttaaactgggtagtcagtgatagataatatatattctgtcacttctaataaggtgccttctcctttaggtcagggtggttctaaaatggaaagaaaacacaatagggtaagtagtgcttgtctaagccagttacaacacagactcttaaagaggatcaagcccttcatttttctaacaacaaaaaatcacctatagaatatctaatttgtgatcttttactagatctgattttttaaaataatgtaatttccggccaggcacggtggcaccgcctgtaatcccagcactttgggaggccaaggcaggtggatcacctgaggttaggagttcgagactagcctggccaacatggcaaaaccccatctctactaaaaatacaaaagttagccgggcatggtggtgggcacctgtaatcccagctactcaggaggccgaggcaggagaatcgcttgaacccgagaggcagaggttgcaatgagccaagatcgtgccattgcactccagcctgggggacagggcaagactgtctctcaaaataaaaaaaaataataaaaataaaaataaaagtaatttccaaaacctcatctcatggaaagatcacaggatgaaggaaagctagactcaactctgtgaatagaagttgctatactgtaagtaaagcaacaattcagaatactgaatgagtttaaattgttttatatagcacccttttgggctagggttaattactagatctgacttggataatttgacactttgggaaatgaactctgttcttgagacttgttcagtgtattttaaacatctgaggaagaaaacttaaatatgcacctatttatacctattctttctttaggtcaacatttaacacccactgcatacattaatttgtccttgtctgctcactccagcaatttagaccttaacagtcacaagagacgttcttctgttacaaagccttagtaaattaaggcagttttgattatattctaggtccacctatgtctgaagctaaattcagtatctaactgctaatgaacaagtttccaaaatactgtaaaaatacaattagtcaatttgagtaaatgcaaatatgatgagaaatcaatttgctatttggcctggcaaatgggaacagtaaaattctgctttactcttctctagtctccttgccccagctgcacccactaccccaaagttggcagttttgaggtatgattttcaaggaatttttttagtattaacatctccctctgagaactatgtacctaaggtcacgcatacaactagtcaattctgtttttattactctaactatgtagaaacagtaagtcacttaaaacaatcacttggctgggttttttcccctttgtgccacattgattcaccctgacccaagaactccagggaaaattctttaatgtcaactgggcaactcattaacctctctttaacatcaagggcttgggaaaaaaaaaaaaaaggttagccacaggaataacaaaaacctggaatttatctttcaggttttgctttctctttctcactttgtttaaagtatctcgtactcacagttcacaaattaaccttcactgtctctttcacattaagagcttatgcttaaagcatgccccccttttctaacttgctggtttaccataaactcccctaagtaataaaattcctaacccagtactgagagtcctccttctctgccacttgggcattattttactagtttttaagccatcatcgcacaagaatccaaaaacccttaaattttttaaccactggcaaatatgtacagcaaattaggttaagcatttaatctggctcatgctctatcatactaaatattcaggtttatcataaactccttaaaaaccatcaaaggtcaaccagaaactgataactcttgaaaggagcaaacaggtaagatctttggagtttaagcttttctgagatgtgttgtgaaaaatctaacgtgtttatcgtatattcaatgtaacaacctggagaatcacaactatatttaaagagcctctggaaaatgaggccagtacagtgtgactacatgtttaattttcaatgtaatttattccaaataaactggttcatgctgaccacttgtattcaactaacaa

SEQ ID NO: 146950 - DNA, 1507 bp, Homo sapiens
  Payload ID: 9068
  Gene Symbol: KLRC4-KLRK1
  Gene Name: KLRC4-KLRK1 readthrough
  ENST ID: ENST00000539300
  CDS Start-End: 1-451
agaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgctactggggataaaggaaggagaaataagtcaactaaaatttgagcacctgctaataggtatgtgtggggacttcccagttggctgtaagttgccatttgaactaaacgaaataggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaa

SEQ ID NO: 146951 - DNA, 1750 bp, Homo sapiens
  Payload ID: 9068
  Gene Symbol: KLRC4-KLRK1
  Gene Name: KLRC4-KLRK1 readthrough
  ENST ID: ENST00000543572
  CDS Start-End: 1-114
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 146952 - DNA, 1309 bp, Homo sapiens
  Payload ID: 9068
  Gene Symbol: KLRC4-KLRK1
  Gene Name: KLRC4-KLRK1 readthrough
  ENST ID: ENST00000543812
  CDS Start-End: 111-338
agaataaaaaacatttgccaagacctcatgcccttttagtaaacgaatgtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgctactggggataaaggaaggagaaataagtcaactaaaatttgagcacctgctaataggtatgtgtggggacttcccagttggctgtaagttgccatttgaactaaacgaaataggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcggtaacactgccaactgagactaaaggaaacaaacaaaaacaggacaaaatgaccaaagactgtcagatt

SEQ ID NO: 146953 - DNA, 1074 bp, Homo sapiens
  Payload ID: 9068
  Gene Symbol: KLRC4-KLRK1
  Gene Name: KLRC4-KLRK1 readthrough
  ENST ID: ENST00000588447
  CDS Start-End: 93-320
caagacctcatgcccttttagtaaacgaatgtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgaaatttctgggctccctgtcagttctctcatgggttggcatctctcgtagtagcagtgatcatccatgggtgtcaataaatggctcaacgttcaaattgaagtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccag

SEQ ID NO: 146954 - DNA, 944 bp, Homo sapiens
  Payload ID: 9068
  Gene Symbol: KLRC4-KLRK1
  Gene Name: KLRC4-KLRK1 readthrough
  ENST ID: ENST00000585507
  CDS Start-End: 93-320
caagacctcatgcccttttagtaaacgaatgtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgaaatttctgggctccctgtcagttctctcatgggttggcatctctcgtagtagcagtgatcatccatgggtgtcaataaatggctcaacgttcaaattgaactactggggataaaggaaggagaaataagtcaactaaaatttgagcacctgctaataggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaact

SEQ ID NO: 146955 - DNA, 910 bp, Homo sapiens
  Payload ID: 9068
  Gene Symbol: KLRC4-KLRK1
  Gene Name: KLRC4-KLRK1 readthrough
  ENST ID: ENST00000591937
  CDS Start-End: 183-410
caagacctcatgcccttttagtaaacgaatgaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgaaatttctgggctccctgtcagttctctcatgggttggcatctctcgtagtagcagtgatcatccatgggtgtcaataaatggctcaacgttcaaattgaagtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttca

SEQ ID NO: 146956 - DNA, 1085 bp, Homo sapiens
  Payload ID: 9068
  Gene Symbol: KLRC4-KLRK1
  Gene Name: KLRC4-KLRK1 readthrough
  ENST ID: ENST00000590131
  CDS Start-End: 93-320
caagacctcatgcccttttagtaaacgaatgtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaa

SEQ ID NO: 146957 - DNA, 1239 bp, Homo sapiens
  Payload ID: 9068
  Gene Symbol: KLRC4-KLRK1
  Gene Name: KLRC4-KLRK1 readthrough
  ENST ID: ENST00000586581
  CDS Start-End: 1-451
agaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcgg

SEQ ID NO: 146958 - DNA, 996 bp, Homo sapiens
  Payload ID: 9068
  Gene Symbol: KLRC4-KLRK1
  Gene Name: KLRC4-KLRK1 readthrough
  ENST ID: ENST00000585711
  CDS Start-End: 1-107
ggattacatattccaacagttgttattacattggtaaggaaagaagaacttgggaagaaagagtttgctggcctgtgcttcgaagaactctgatctgctttctatagataatgaggaagaaatgaaatttctgggctccctgtcagttctctcatgggttggcatctctcgtagtagcagtgatcatccatgggtgtcaataaatggctcaacgttcaaattgaagaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcgg

SEQ ID NO: 146959 - DNA, 1086 bp, Homo sapiens
  Payload ID: 9068
  Gene Symbol: KLRC4-KLRK1
  Gene Name: KLRC4-KLRK1 readthrough
  ENST ID: ENST00000590323
  CDS Start-End: 183-410
caagacctcatgcccttttagtaaacgaatgaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgaaatttctgggctccctgtcagttctctcatgggttggcatctctcgtagtagcagtgatcatccatgggtgtcaataaatggctcaacgttcaaattgaaatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaa

SEQ ID NO: 146960 - DNA, 1025 bp, Homo sapiens
  Payload ID: 9068
  Gene Symbol: KLRC4-KLRK1
  Gene Name: KLRC4-KLRK1 readthrough
  ENST ID: ENST00000588263
  CDS Start-End: 183-410
caagacctcatgcccttttagtaaacgaatgaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacct

SEQ ID NO: 146961 - DNA, 985 bp, Homo sapiens
  Payload ID: 9068
  Gene Symbol: KLRC4-KLRK1
  Gene Name: KLRC4-KLRK1 readthrough
  ENST ID: ENST00000591546
  CDS Start-End: 183-410
caagacctcatgcccttttagtaaacgaatgaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacgtacatctgcatgcaaaggactgtgtaaagatgatcaaccatctcaataaaagccaggaacagagaagagattacaccagcgg

SEQ ID NO: 146962 - DNA, 2266 bp, Homo sapiens
  Payload ID: 9069
  Gene Symbol: KANK1
  Gene Name: KN motif and ankyrin repeat domains 1
  ENST ID: ENST00000382286
  CDS Start-End: 1-850
gtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctt

SEQ ID NO: 146963 - DNA, 1926 bp, Homo sapiens
  Payload ID: 9069
  Gene Symbol: KANK1
  Gene Name: KN motif and ankyrin repeat domains 1
  ENST ID: ENST00000382289
  CDS Start-End: 1-1059
gagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgggccaggtgcagtggctgacacctatgatcccaacacttcgggaggccgatgcaggtggatcacatgagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctc

SEQ ID NO: 146964 - DNA, 5249 bp, Homo sapiens
  Payload ID: 9069
  Gene Symbol: KANK1
  Gene Name: KN motif and ankyrin repeat domains 1
  Uniprot ID: Q14678
  ENST ID: ENST00000382293
  CDS Start-End: 797-4381
gaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 146965 - DNA, 5051 bp, Homo sapiens
  Payload ID: 9069
  Gene Symbol: KANK1
  Gene Name: KN motif and ankyrin repeat domains 1
  Uniprot ID: Q14678
  ENST ID: ENST00000382297
  CDS Start-End: 123-4181
gcgagcgagcggccggcaggttgggaggagcggccgaaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 146966 - DNA, 5581 bp, Homo sapiens
  Payload ID: 9069
  Gene Symbol: KANK1
  Gene Name: KN motif and ankyrin repeat domains 1
  Uniprot ID: Q14678
  ENST ID: ENST00000382303
  CDS Start-End: 653-4711
gcccgagggtgtttcggggcgtccgaagcgggcgtgctccagcctgctcagcagcgagtggttggaaattagcaaagtgagagggtgaaaggaagcaggaggaggagggagttctagcgaagacttcggagggaagcaacccatcccctgccacaagaaagcaccgccactccagtgggaacggacacgcgtgcacacagccacgagtgaggagagaatacagcagttccaaggacaagggattcgtaccactgctcctcactcagtaaatagcagagacagaatttgaacggtctcactctgtcacctgagctagagtgcagtggtgcgatcacagcttactgcagcattgaactcctgggctcaagtgatcctcttgcctcagcctcccaagtaactgtgactgcagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctcttt

SEQ ID NO: 146967 - DNA, 5688 bp, Homo sapiens
  Payload ID: 9069
  Gene Symbol: KANK1
  Gene Name: KN motif and ankyrin repeat domains 1
  Uniprot ID: Q14678
  ENST ID: ENST00000619269
  CDS Start-End: 759-4817
gagctccgggtccgcggcggagcgagcgagcggccggcaggttgggaggagcggccgaagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggttgaatgcctttgagaacttgatgcataaaatttgcatgactcctcactcctttctggatctctcattggactcaagccagcatggctcacaccacaaaggttaacggcagtgcctcaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatgcatgtacaaacaatgaaagtacactgaagtccatcatgaagaagaaagatggtaacaaagattcaaatggcgcaaaaaagaatcttcagtttgttggcattaatggagggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtatgaattaagtgaaaagatgttgtctgcatgcaacttactgaaaaatactataaatgaccccaaagctttgaccagcaaagatatgaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccgatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgatggcagcactgcgctctcaatcgccctggaagcaggacacaaggacatcgctgttcttctgtatgcccatgtcaactttgcaaaagcccagtctccgggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctctttt

SEQ ID NO: 146968 - DNA, 576 bp, Homo sapiens
  Payload ID: 9070
  Gene Symbol: KANK2
  Gene Name: KN motif and ankyrin repeat domains 2
  ENST ID: ENST00000592903
  CDS Start-End: 569-576
gctcgggcggcgggacccagggaaggcagcggccggagcgcgcaagaattagctaggcgtggtggcaggtgcctgtaatcccagctactcaggaggctgaggcaggagaatcgcttgaacctgggaggcagaggttgccgtgagctgagatcgcgccattgcactccagcctgggcgacaagagcaaaactccgtctcagaaaaaaaaaaaaaaaagagttgatgtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggccca

SEQ ID NO: 146969 - DNA, 2952 bp, Homo sapiens
  Payload ID: 9070
  Gene Symbol: KANK2
  Gene Name: KN motif and ankyrin repeat domains 2
  ENST ID: ENST00000588787
  CDS Start-End: 1-664
ggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgctttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttga

SEQ ID NO: 146970 - DNA, 5162 bp, Homo sapiens
  Payload ID: 9070
  Gene Symbol: KANK2
  Gene Name: KN motif and ankyrin repeat domains 2
  Uniprot ID: Q63ZY3
  ENST ID: ENST00000586659
  CDS Start-End: 316-2871
gcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatga

SEQ ID NO: 146971 - DNA, 542 bp, Homo sapiens
  Payload ID: 9070
  Gene Symbol: KANK2
  Gene Name: KN motif and ankyrin repeat domains 2
  ENST ID: ENST00000588724
  CDS Start-End: 409-542
tgcggcgcgcgcgaagacgctcgggcggcgggacccagggaaggcagcggccggagcgcgcaaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctgga

SEQ ID NO: 146972 - DNA, 2703 bp, Homo sapiens
  Payload ID: 9070
  Gene Symbol: KANK2
  Gene Name: KN motif and ankyrin repeat domains 2
  Uniprot ID: Q63ZY3
  ENST ID: ENST00000589894
  CDS Start-End: 1-2526
atggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcggtgagtctcaatccggccgggtaggcacgggatgggtgggtctctgaaaggacagagatttgttgtttttgtttttgaggcagagtctcactctgtcgcccagggtggagtgcggtggcacgatctgggctcattgcaacctccgcctcccggcttcaagccattctgctgcctcagcctcctgagtagctgggataacag

SEQ ID NO: 146973 - DNA, 3048 bp, Homo sapiens
  Payload ID: 9070
  Gene Symbol: KANK2
  Gene Name: KN motif and ankyrin repeat domains 2
  Uniprot ID: Q63ZY3
  ENST ID: ENST00000589359
  CDS Start-End: 469-3048
gcggcgcgcgcgaagacgctcgggcggcgggacccagggaaggcagcggccggagcgcgcaaggggtgagcctccaggcaaatggaaaacggaatttcctgcaattggtgaccatgtgttccaggtgttgaaagacagagaagcgaagacagagacgtggaaagacagggagagagacacggagagagacgcagaaggacagagacgtggagagagacgcagagagacagagacgtggagagacacagagagacgtggagagacacagagagacttggagagagacaaagcaagacaggacgggagaacaaggacaagctcaggtgcccctggagccccagccctgccttcatgcccagcaggtgccctacctggcccatcctcccaaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtccatatggtgaagaagattagcatcacagagcgaagctgcgatggagcagcaggcctcccagaagttcctgccgaatcgtcttcgtcacccccggggtccgaggtagcctcccttacacagcctgagaagagcacaggccgagtgcccacccaggagcccacccacagggagcccaccaggcaagcagcctcccaagagtccgaggaggccgggggcaccgcacctccgctgtcctcccctccaggcgggcccccggcaggcgtgcgatctatcatgaaacggaaagaggaggttgcagaccccacggcccaccggaggagcctccagttcgtgggggtcaacggcgggtatgagtcgtcatccgaggactccagcacagcagagaacatctcagacaacgacagcacagagaacgaggccccagagccgagggagagggttccgagtgtggccgaagccccccagctcaggcctgcagggacggcagcggccaagaccagccggcaggagtgtcagctgtctcgagaatctcagcacatacccactgctgagggggcatcaggatcaaacacggaggaggagatcaggatggagctaagccctgacctcatctcagcctgcttggccctggaaaagtacctggacaatcccaacgccctcacagagcgggagctgaaagtggcctacaccacagtgctgcaggagtggctgcgcctggcctgccgcagcgacgcacaccccgagctggtgcggcggcacctggtcacgttccgggccatgtctgcgcggctgctggactacgtggtcaacatcgccgacagcaacggcaacacagccctgcactactccgtgtctcatgccaacttccccgtggtgcagcagctgctcgacagcggtgtctgcaaggtggacaaacagaaccgtgctggctacagccctattatgctcaccgccctggccaccctgaagacccaggacgacatcgagactgtccttcagctcttccggcttggcaacatcaatgccaaagccagccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgatgggagcacagctctgatggtggccttggacgcagggcagagtgagattgcgtccatgctgtattcccgcatgaacatcaagtgctcgtttgccccaatgtcagatgacgagagccctacatcatcctcggcagaagagtag

SEQ ID NO: 146974 - DNA, 624 bp, Homo sapiens
  Payload ID: 9070
  Gene Symbol: KANK2
  Gene Name: KN motif and ankyrin repeat domains 2
  ENST ID: ENST00000592675
  CDS Start-End: 257-624
gagacacagagagacttggagagagacaaagcaagacaggacgggagaacaaggacaagctcaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctggagacccagctcaagaaggcgctgcaggagctgcaggcagctcaggcccggcaggctgacccccagccccaggcctggccaccgccggacagcccggtccgcgtggatacagtccgggtggtagaagggccacgggaggtggaggtggtggccagcacagccgctggcgcccccgcacagcgggcccagagcctggagccttacggcacagggctgagggccctggcaatgcctggtaggcctgagagcccacctgtgttccgcagccaggaggtggtggagacaatgtgcccagtgcccgctgcagctaccagcaacgtcca

SEQ ID NO: 146975 - DNA, 923 bp, Homo sapiens
  Payload ID: 9070
  Gene Symbol: KANK2
  Gene Name: KN motif and ankyrin repeat domains 2
  ENST ID: ENST00000590685
  CDS Start-End: 481-923
agagaaaattgtttccataaaggggaaaggcttcactcctagctgcctccccaactttccctaccccttccccccgacccagtccaggcctgacccagctctcagctttggggtcactgggggtccccttcgccatgctttgcctctctttgtccccctgcgtctctgtctcctcagatccttgcaggaagacgaggttcccttcttccccaaccccttagcgcctcaacccccatccttccgtgtggccagctccgggcctgggctgaggggagggggtgcaggaagggtggggcctgttgggcttggggccccccagccccagggctatgtggaggctgggctatgggaacagctggagcctgtccagggcctggacagatgtgcaagcaggcagtgaggtaagcctcagccggtgctgcaggcagtctgactcgcagtccctcaagtgacttccaaggagcatctgtagaaaagaagatggcccaggtcctgcacgtgcctgctcccttcccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccct

SEQ ID NO: 146976 - DNA, 2787 bp, Homo sapiens
  Payload ID: 9071
  Gene Symbol: KANK3
  Gene Name: KN motif and ankyrin repeat domains 3
  Uniprot ID: Q6NY19
  ENST ID: ENST00000330915
  CDS Start-End: 67-2532
gggctcgggtgcgggcgcggctggggctgcggcttcagggtgcctctgacagctgctgcaggaaacatggccaagtttgccctgaatcagaacctgcccgacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgcccgccgcgccccgggacccccgacctcgcgccgtccccgcgcgccccggcccggcctcgcgggcgcacgtagcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgcccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagtctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggcatcctcaaatccatcatgaagaagagagacggcacacctggtgcccaacccagctccggacccaagagcctgcagtttgttggggtcctcaacggagagtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgagggcaccagtgccctggccatcgccctggaggctgagcaggatgaggtggccgctctgctacatgcccacctgagctcgggccagcccgacacccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctacta

SEQ ID NO: 146977 - DNA, 506 bp, Homo sapiens
  Payload ID: 9071
  Gene Symbol: KANK3
  Gene Name: KN motif and ankyrin repeat domains 3
  ENST ID: ENST00000595639
  CDS Start-End: 67-506
gggctcgggtgcgggcgcggctggggctgcggcttcagggtgcctctgacagctgctgcaggaaacatggccaagtttgccctgaatcagaacctgcccggcatcctcaaatccatcatgaagaagagagacggcacacctggtgcccaacccagctccggacccaagagcctgcagtttgttggggtcctcaacggagagtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcct

SEQ ID NO: 146978 - DNA, 2672 bp, Homo sapiens
  Payload ID: 9071
  Gene Symbol: KANK3
  Gene Name: KN motif and ankyrin repeat domains 3
  Uniprot ID: Q6NY19
  ENST ID: ENST00000593649
  CDS Start-End: 67-2589
gggctcgggtgcgggcgcggctggggctgcggcttcagggtgcctctgacagctgctgcaggaaacatggccaagtttgccctgaatcagaacctgcccgacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgcccgccgcgccccgggacccccgacctcgcgccgtccccgcgcgccccggcccggcctcgcgggcgcacgtagcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgcccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagtctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggcatcctcaaatccatcatgaagaagagagacggcacacctggtgcccaacccagctccggacccaagagcctgcagtttgttggggtcctcaacggagagtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgcgagctgagcccgcgtctgagggaggcgtgcgtagcgctgcagcggcagctgagccggccccgcggagtagccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgagggcaccagtgccctggccatcgccctggaggctgagcaggatgaggtggccgctctgctacatgcccacctgagctcgggccagcccgacacccaggctggagtgcagcggcacaatctcagttcactgcaacctccacctcccaggttcaagaaattctcctgcctcagcctcccaagtagctgggattacaacagctgtgagccatcgcgcctggcacaacttacaattttttgacttcatgatagcataaaagcaatgtgtgcttagtaaaaaccacacttcagcagagtattcaataaattacataagacattcaa

SEQ ID NO: 146979 - DNA, 1191 bp, Homo sapiens
  Payload ID: 9071
  Gene Symbol: KANK3
  Gene Name: KN motif and ankyrin repeat domains 3
  ENST ID: ENST00000610351
  CDS Start-End: 353-991
atccccgccaggcatcctcaaatccatcatgaagaagagagacggcacacctggtgcccaacccagctccggacccaagagcctgcagtttgttggggtcctcaacggagagtgagcgcctttcccctcctgtggcagcttctgccgggacatagactggggttggaaccccagctctgcccctctactggcagcgtggtctgggcaatcctcagtttcctcatcgttaaatgggaacggccacacccacatcgcaggactccagaacgagcccacaggggaggtttagcagacacctcccaccctgcccccaggtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgagcggcgctcgctagttgtttggagaggaggcggctgccctcctcctggtcggcgctgtccccgatccatcctgagtctctcctggcctcctctgcaggtgcgagctgagcccgcgtctgagggaggcgtgcgtagcgctgcagcggcagctgagccggccccgcggagtgccagcgacggcggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggtcagagccaagggagggtgggtggacaccaggaaatgggtggggggagagggcaggggctgacctaggctcaaagactctggagaggaaagcagagaatggctgtccagcacagggcaccactcctccttgagtttattttattttattttaattttattattttattttattttattttattttattttatttttgagacggagtttcacactgtcaccaggcaggagtgcagtggcgcgatctcggctcactgcaacctccgcct

SEQ ID NO: 146980 - DNA, 2080 bp, Homo sapiens
  Payload ID: 9072
  Gene Symbol: KANK4
  Gene Name: KN motif and ankyrin repeat domains 4
  ENST ID: ENST00000317477
  CDS Start-End: 381-782
ggcaagctggagggagctgcagggacagaggccaaagctgtctttccttgtgtaagggaggaactcttgctggccggggaacctcttggaattggtcttttttggggtttcagaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 146981 - DNA, 2103 bp, Homo sapiens
  Payload ID: 9072
  Gene Symbol: KANK4
  Gene Name: KN motif and ankyrin repeat domains 4
  Uniprot ID: Q5T7N3
  ENST ID: ENST00000354381
  CDS Start-End: 267-1370
gagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 146982 - DNA, 3023 bp, Homo sapiens
  Payload ID: 9072
  Gene Symbol: KANK4
  Gene Name: KN motif and ankyrin repeat domains 4
  ENST ID: ENST00000371150
  CDS Start-End: 1235-2290
aaaaaagattttagtacttccaggaacccagtggaataaaaactgatgtgtgtgacagtggaggctcgggacctctactcttgcctttgctctaaggttgggtctgactatgggcccactgcctacagctgtatggatagcacagggcacaaagatgccagccagggagggcaaatgagagttgaaagccagcccacactccatttgccaagccttgcgctgcagcaccacatccacccagagggggctgttctcatttgcattgtgcaaaggcagtgtctggggccaagaatggccctgctgcgtggactccagacctcttcctgggcttttgcattcctgtgttcctctctggttcttgcatagtagaggttttctctggcctggttttggaggagcattatattgatatctggtatagttcactgaatattttctctgcgtgcatgtgtgtgtgtacgtgcatgtgtgtgtgtacaggggcaggagattaagtgctgctcacatatggaaatgggcccttcggctgagcagcacttcctgttgtaacagatcaaaccctcttcactgtcgggtaaagtggaaccacgttttgctttgcagggcagcatgcgagtctgcttcctgccacaaatcacaatttgactgctttctcattgtttcagtgctagttctagccttccccgttgggagccgcctcctgtcctgttgagcacattgcaagatctgtgtccttgctcgtgtatctactgtgagcacggtgtcatcaccacccccacaaccctagtgtcagtatgcacttgtgagccaggaaggaccactgaggtgcccttgagcagaagtgggtgctagaccatgagtccagaggcctacgttctgctcctacactcccattcactgagcaagtctgggcctcagatttcccagctgtaagacagggacaacaatggcacctacgccacatggttcttcatccacacttagaggggcattgttaacagagacagttctcccaacattgagcagaaagcaaggctcctccaagaggtccccaaaacattgatttacatgatctggttccctgtccctccttacctctccacacacctgcaacccttgtcccctcaaagcaatatcctggttttgctacattcccatgcatccccaagatcattctaacctgtgatgttgtgtctgcctagagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaat

SEQ ID NO: 146983 - DNA, 4665 bp, Homo sapiens
  Payload ID: 9072
  Gene Symbol: KANK4
  Gene Name: KN motif and ankyrin repeat domains 4
  Uniprot ID: Q5T7N3
  ENST ID: ENST00000371153
  CDS Start-End: 380-3367
tcgggcgctgttggcagctggcgacgcggggcgaagccgcggctggcggcgcctggccagtcccgcatccgccgcggtgggtgtgcccgcaggggtgcgccggggccagggccgagaccgtcggccagagggcgcctggagggtgtgcgcgccgcggacgaccagggtgcgccagccccggggtgcgcgcctgggacgcggacagtgcacccggaggttgcgtgcgctccgaagccggggtgtgcgcctagctgccccggccccgtgcaccgcgggccgcctcgcgcaggacttccgcagctcgccaagaaccttcaacaagttttacagactcattggatgaagagtgcctgagacactgagggtcagcgctccaaagatggagaagacagatgccaaagaccagtcctctcagggggatgaagagaaagaccctccgaagagccacccttattctgtggagaccccatatggctttcatttagacctggacttcctcaagtatgtggatgacatcgagaagggaaacactatcaaaagaattcctatccacagaagggccaagcaggccaaatttagcactctgccccgaaacttcagccttcctgacagtggggctcgcccccctgcagccccgcccctccaaaactggtctcccgtggtgccaagggaggcatcacttgggacacaggagcaaaaccagtcaccaccgcttggtaatgccccccaggcctcaacaagcaggagtgaggtgagctaccacaggaaggctctgttggcagaggccaccagacagttggaagctgctgagccagaggatgccgagctcacttttgggagtggacggccccagctcttgagagcatccagcatgcctgccacgctgctgcacagcagggcttctgaggagccaggcctgagcctggggccccctgcccctcctgccctccctccccttcagggtgaaggcagtgtctgtgatggcacctttgaacctgcagaaggattggcaggtttccacagctccagcccacgagcatcaactcggattccagagctggtccaggagggagctgagcctccagagggtgtggtgaaggttccaaatcacctccctctcccaggccctcctttctcattccagaatgtgcttgtagttctagaggacaaggaagatgaacacaatgccagagaagcagaggtgttgttcacccctggctcccctacgccaagcccgccacctctgccatcacccatccctgagaatgagctcctcctggaagaaatcgagctcaacatcagcgagattccacccccgccacctgtagaggtggacatgagaagcattggcatcagggtaactgaggaaagcctgggccttgccagggtggatccaggcagcatctccagcctgaaacagcaggtctcggccctggagggagagttgtctggaagaaccgaggaactggcacaggtcagaactgctctccagcagcaggaagaggaaatcaaagctagggagcaaagaattcgagagctggagttcactgtagcccaactggaaggacagtttcaccaagagaacgccaaagacactcagggccagacggacgtgatggtgaacactgaccctgtccatggactcttgaccagggagtcgtgtgataagggcattgaagtcaaccttctaggcagcatggagtctgaaagctgggggcaccgaggagaggagaatggcctcctatgggggccagatggtcataaacaagggaatcagagcccagcagaacgtgtgcttctgccccagctgtcactgccacagggacccgagcaggtccttacctcctctgtacatagcttcctctccactgaactcaggattgaagaagcaggcactgaacaggaaggaggccctcagggaggaaccaggggagcaggaggctttctgtggggcagcgacagaaagactcccccagcagggagggaggagaccagttccaatctcccagggaaggagcacccgggaaggccaccaagctcgccaacggatgccactattgggcagtatgtgaagaagatccaggagctcctgcaggagcagtggaactgcctggagcatgggtacccggagctggccagcgccatcaagcagccagcctccaagctcagcagcatccagagccagctgctgagctccctcaacctgctgctgtcggcctactcggcccaggctcacccacccaaggagccaccggcctcctcctcctccccgccagtggagatctccccatcgaccagccttaaatccataatgaaaaagaaagactatggcttccgtgcaggaggtaatgggaccaaaaagaaccttcagtttgttggggttaacggtgggtatgagaccacctcaagtgaggagaccagcggtgaggacagcaccccagaggacttgtctgacagcgaggcagagaagaagtgtgacggcccagatcacaagcatgtcaaagatgcccatctcacctgcgaggctgggcagggcatccctgagggcacctgccatgctgcccaggaaagtgggcctggggaagaagtcccccactccaaggccgagagatataaaccctcagaagaatttcttaatgcatgccgggcactgagccagcatctgccagaaactgggaccaccacagaccagctcttgaggcaaagcttgaacaccatcagtcaagagtggttccgcgtctccagccggaagtcgtctagccccgccgtggtggcctcctacctccacgaggtccagcctcactccccacacttcctgaaactgcttgtcaacttggccgatcacaacgggaacacggcccttcactacagcgtgtcccactccaacttctccatcgtgaagctgctgctggagacaggcgtctgcaatgtggaccatcagaacaaagctggctacactgccgtaatgatcactcccttggcttccgcagagaccaatgaagacatggctgttgtctggaagctcttaagagaaggaaatgtgaacattcaagctactcagggaggccagactgcgctgatgctgggagtcagccacgacagggaggacatggttcaagcgctgcttagctgccaggcagatgtcaatctgcaggaccacgatggatcctcggccctcatggtggcctgtcaccatggcaacgtggacctggtgcggctgctcctggcacacccagcctgcgacagcagcctgactgacaaggctggccgcacagctttgtccatcgctctgaagtcacccacccatatggaaattgctgggcttctgagagcccacgcggagcagggcaggtccctggggctgtaggggctgcagaagaactggccgtggggaacaaaagccttcttctctggactcctccctcgcccttgaagagggcagaggtcacaggccagagagccacccttctagagaagaaactatgtcaaatatgcacatacattcctgttgtataattctgctcattaggatgctttgtagtttttgccttaggccaagcctgaaaactacacgggcttcagagcagggttcaaggtgcaaggtgaggggtacgtcggtgtcatccaaacatccaaaacatcttcagccttgaattcctcatgactctaccctctgtaacattgtgtagcaagcaggcaggcaggagcacattagcacattagaaaagcaatactttttacatggaattttacagtgcactatctttctgttttttaagcaagtgtatacaaatatgtcccattgatatgcatgtctatagatgggaggggatttaagccaaccccctggcaagcattctgtaggggaccctagaagaatcaccgtgcagactggtgaaactgaacaagcaccatttgggagctttgtttcgatggggttgacagagaaatcttaaaatctgacagggtagaagaagcactttggcatcaatgccatatgtacagtcttgactatttctgagtcatctagtggctccaatttgctccagggaaattggaattaattaagaaatttattatctagtaagttgctatgtaataaagaaaaaaaagaaattcaatccaatgacacacaccacatgtatttgggcagagtcagattctctcagctattttgagtctgtggaagaaacaaaaaaaagcttcctcctgaggatgggttattgtcatcaagaagccacctgcatagccgtatccattacctcatggtaattcccggtgctttcccctcatatcccctagaagcaaatatctgttctgaggttttttgggacttctggctgcaataggagcaagggacccaggcagggcagagcaataccttccgaagcttccatattccctggggccagcacatgcaaggtttatatggtcagtagctcacgtgaagtcatctgaatctttcttaaatctgctctcttaaaatctcttatgcaaaaaaaaaaaaaaaaagccccttatataaaaagaagtaatgtcaaagtttgatgagctttacattggaaactcaaaagcttgcactctcattttggctcagatgccaatttgctgggtgcccctgtggtgagtcatgaaacctccttgggccgcaatttcatcatctct

SEQ ID NO: 146984 - DNA, 674 bp, Homo sapiens
  Payload ID: 9073
  Gene Symbol: KRBOX1
  Gene Name: KRAB box domain containing 1
  Uniprot ID: C9JBD0
  ENST ID: ENST00000383748
  CDS Start-End: 143-529
gtttttgtcgcgcgaggttttggtttgtgaggatcggcgagtggcgcccaccatctctgcttgctgaaaagctgcagaggccgccaggagcccacgcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 146985 - DNA, 2566 bp, Homo sapiens
  Payload ID: 9073
  Gene Symbol: KRBOX1
  Gene Name: KRAB box domain containing 1
  Uniprot ID: C9JBD0
  ENST ID: ENST00000418176
  CDS Start-End: 2035-2421
agttattttcgcctgccatagtgtacaccagtcttgaaacttgttactgtcgtagagcaaccaaaaatttgagaataccgaattgtattccctacccgtccccaggatgtcccattttggaaaatatggagccctgcgatctggattggctcataagaatgttaaatctaaaaagactgatcgtatccgtcatgcacctaatgtgtgtccagtgtttaacatagtttcctatgtacaggattggagatgtcgaaagatttcttgacctcttaacattgttcattatattcttttctttagattctctgaacttttactccactgtcataatttaattgtcaaggttcataggataacattcgatgtccctgccattagtcaactatgttgggagtgtgatttgttctccaatgtggcttgttatttatgtttcatctccacttagctttccccataggaagacacttccatagggagtgttttgtgttttgtagggtgacctctgttgtagttctatttccagatgatttccctttcgcagattgtcagctgtgcagatcagacctttttgcttaagtccttttgtttgatacgctaatcctattaagtatccactgtaagggacatttactgccgatacaatgacagtatcatgattttagagaattagattccacaattacaagggttaactatttacttagtatgaatcactgcttttgttaccctttcttggacagaaaccatccatgaatttagcagcattacttgtgtaggtttacattgtgttttcttttaaagtacttctctttacactcataaatatttctccttactggactccctgttaacttccaagatgccttttctggcgtctcctgacagctgtttctctgacaccttcagcttcctctaccttcctgaatggctttctggattcactaagaagagtcattggagggaggggcagtgcactggctttatagtgttttgtctgatgctgttgcagtaccctaagacttacagcaaactgcagatatggagttggaacggaagttgtttttaaggtctatgagtatatgcacttttatgtgtttgtttatatgctttttgaatatctctgatccaactgttggcagctctttgtatttcaggtgttgtctttaatgcataaatattgatgattcactcttgaaaggcaaaagacttacttcctaatgatgaactaattaaatgacccagaatgagagttggaactagtttagaaatgaaattgttttgtttccttatactataacatttggaacttgaagtatttgggacatgttatgaagttgatggattcttttaatatggtaatgttttctttctcatcacccactccaaacacctttataaaactgaatgagtatcttgtatttaggggaaaaatagtagtagggaggcatcaaaatatttctgataactattttcaaagtctgttcaactttcattacttcagtcatagaaactcttgttctaatattaagtagcataggaggaaaaacatgctgaggtcttacagtgtttaatggatttcttttatataactcattcctatctgtactacataactcattcttatctgtactgtatggatttcagggatcttaactgtttagaattccaactttcttttctgcctataacactctgtccactgtctaccttagtttccttttctgtttcctgtcctgtgatgtattctatggattagctgaaattatagttttctcagtccactttttcatcactcattccgtggatgattctacctcctttttgcatttctctgtatgcctgctatctcgcctttgtgagattgataataagcaataactaatgaacggttattgatatagccttcaaaacagatgggtcagaggttgtttgtaggacttatggtcaataaagttattatcgttaatgttttttttctttaccttcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 146986 - DNA, 826 bp, Homo sapiens
  Payload ID: 9073
  Gene Symbol: KRBOX1
  Gene Name: KRAB box domain containing 1
  Uniprot ID: C9JBD0
  ENST ID: ENST00000426937
  CDS Start-End: 295-681
gggatcctttctggaatggaggtcttatgagctgctattgaacacggcagagcctgttggtgacctgcacacaggagccctccagtcagtactgattgaattactcaaggctgcctctctgcaaagttgagcagcatttccatttcccaaaccggctctgatttcccagctggagcgaggggaaacaccctggtgctcggttcctcggggagctctggatggagaggccccaaggggcatctcctcagcacctgagacttttacctttacccagaaaggaataaaagaggtcagatgatgacagctgtgtccttaacaaccaggccccaggaatcagtggcttttgaggacgtggctgtgtacttcactacgaaggaatgggccatcatggtgcctgccgagagggccttgtacagggatgtgatgctggagaactatgaggctgtggcctttgtagtgccacccacttccaaaccagctttggtctctcatctggagcaagggaaagagtcctgtttcacccagccacagggagtcctaagcaggaatgactggagagcaggctggataggatacttggaactaagaagatatacttacttagctaaagcagtgttacgtagaatagtatcaaaaatttttcgaaatcgtcaatgctgggaagacaggagaaaagcttaattcttgacatttaaataccagttttccaagtaaggagttgatgtaagagccaccttaaacgatgtcaaatacacattttctttttctgtagactggtagatttaatgtttttcattcattaaaataactcattttgatgtacaaa

SEQ ID NO: 146987 - DNA, 1354 bp, Homo sapiens
  Payload ID: 9074
  Gene Symbol: KRBOX4
  Gene Name: KRAB box domain containing 4
  Uniprot ID: Q5JUW0
  ENST ID: ENST00000298190
  CDS Start-End: 197-697
agttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttt

SEQ ID NO: 146988 - DNA, 2774 bp, Homo sapiens
  Payload ID: 9074
  Gene Symbol: KRBOX4
  Gene Name: KRAB box domain containing 4
  Uniprot ID: Q5JUW0
  ENST ID: ENST00000344302
  CDS Start-End: 632-1147
ctattcccaggagggtaaaaaagcgggaacaatggctttcaggacggagggacacaaacacccaatgccgcagcgactgggagggtcgcgatgcaggaggacgaaatgggagaagggggacaagggggacttcggcctccctgcgggcgggagctaggccgctggaaagtccgctcgcctctcgccggcaagggatgacgccctgggccttttgtaccactcgccacggaaaatggtcacacgcttttgtcctcaagccgaacactatcagaaacacggggtccctggaagccgccatcttggccattggcggtggcgcacccacccccgtgctactgcgcgtgcgcggcgctgcgacacactccgaccccatcccgcgttcccagggggcggtgggaagcggaagtgctccgctgacccgggagggcggtccctagttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagaagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaatagtgtgatgaaattttgcactgtcctgctctttcctgctcaggatgcaaatcagtgaatctttttttttttttttttgagacagagtcttgctctgtcatccaaactggagtgcagtggcacaatcttggctcactgcaacctccgcctcttgggttcaaccgattctcctgcctcaacctcccaaatagttgggattacaggcacatgccaccatacgcagctaatttgtatttttagtagagacagggtttcaccatgttggccagcctggtcttgaactcctgacctcaagtgatccgcctgcctcagcttcccaaagtgctgggattacaggcatgagccactgcacccggcttgaatcatccttttgtccagtattatatccatgctgtatatgctacccgcccactagtcccttagctgtctcagttgtcagattgactgtcatgggattgcagtgcttgcattaaagctacccttattgtataatgaccccaaagtgcaagagtagtgatgttggcaatttgcatacaccaaaaataagttataaagtgcttccttaaagtgaaatggttaaagttcttgacttaataaagaaaaaaaatgtatgctgaggttgttaagatttacagtaagaatgaatcttctatccaagaaattgtgaaggaggaaaaagaaacttgtgctagttttgctgtcacatctgaaactgcaaaagttgtggccacagtgcatcataagtgctaagacgaaaaagacattaaatttgcggatggaaggcgtgaatagaaatgggttctgacagcaatcaggttcggtactattcacagtttcaggcatccgctagggatcttggaacatatcccccatggataagggaggggtactgtaccttgtcatattgtgcattaaagaattcattgagtgtaatcatgtaagtctaacacacatttaaaaagctctcagatatcatttcgccttcggttgatgtaagaaaattcaaaagctactcaaatcattcaataaatgataaaattattta

SEQ ID NO: 146989 - DNA, 993 bp, Homo sapiens
  Payload ID: 9074
  Gene Symbol: KRBOX4
  Gene Name: KRAB box domain containing 4
  Uniprot ID: Q5JUW0
  ENST ID: ENST00000377919
  CDS Start-End: 195-491
ttcacactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagatgtatccatttttgcctcatgtattttgaagtgctgttattagtgagagttattttccatggaaattctgtgtaccctaagctatgaaagcatcactgcagaactatttggattgccactgctggggcccactggtttcactaatgcaggaacaatttataggtgaatttatcaacttcgggggttttgtattatacttcaaatgtccatttggaatgcactcctacatgtggtacaggactgtggttctgacttcttgtaagtaacccctgattcttcttaacattttcattagccagtgggtgacatctttctagttcctattttacacacagagatgtcctttgtgactcccagctttaagcaggtagctcaattctaattctctgcacatttgtgccctgtggcctagaattcacctcacactcatgattagagccttagtcccccaactgcaaagccacacagcttcaatttctgttcactccctcactttaaatttcttcttcatttttgtcacataataaatttattttctggtttga

SEQ ID NO: 146990 - DNA, 1247 bp, Homo sapiens
  Payload ID: 9074
  Gene Symbol: KRBOX4
  Gene Name: KRAB box domain containing 4
  Uniprot ID: Q5JUW0
  ENST ID: ENST00000487081
  CDS Start-End: 109-405
gacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccagatgtatccatttttgcctcatgtattttgaagtgctgttattagtctggcaagttgatgagcagatagatcactacaaggaaagccaagacaaacttccttggcaagctgcattcataggcaaggaaacactgaaggatgaaagcggtcaagaatccagaacatgtagaaaaagcatttatctgagcacagaatttgattctgtaaggcaaagactccctaaatattattcgtgggaaaaggcattcaaaacatcatttaaactttcttggtcaaaatggaagctatgtaagaaagaaagatgatggatgtaaagcatattggaaagtatgcttccattataatcttcataaagctcaacctgcagagagattttttgaccctaatcaacgagggaaagccctccaccaaaagcaagcccttagaaaaagtcagagaagtcaaactggggagaaactctacaaatgtactgaatgtggaaaagtgtttatccagaaagcaaacttagttgtacatcaaagaactcacaccggagagaaaccttatgaatgctgcgaatgtgcaaaagccttcagccagaagtcaaccctcatagcacaccagagaactcacacaggggagaagccctatgaatgcagtgaatgtggaaaaacctttatccagaagtcaactctgattaaacataagaaaattcatatggagagagaccctataaatgcagtgtctgtgagaaagccttcagtaggaagtcaactctcattaaacatcagataattcatatgggagaaaccttatgaatgtaataaatgtgggaaatcttttagtgttaaatcaactctcattgtatgtcacagaacataaatgcataagttgcatgctattgtgaa

SEQ ID NO: 146991 - DNA, 730 bp, Homo sapiens
  Payload ID: 9074
  Gene Symbol: KRBOX4
  Gene Name: KRAB box domain containing 4
  ENST ID: ENST00000478600
  CDS Start-End: 192-473
acactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtacagtccttcagagattccagctgaaagcctgtggtatttaacaaggcccatcatcactggtggaatctgaacttcaagtctgatttccttggcacataattttctactaaaagctctgcacctggctgctgtgaatttccaaatctatcccaagtccctgtgtgtcacagtacaatccattaggatttggaagctgtattaatccattttcatgctgctgataaagacagacccgagactgagcaatttacaaaacaaagaggtttaatggacttacagttccatgtggctggggagg

SEQ ID NO: 146992 - DNA, 585 bp, Homo sapiens
  Payload ID: 9074
  Gene Symbol: KRBOX4
  Gene Name: KRAB box domain containing 4
  ENST ID: ENST00000476762
  CDS Start-End: 192-585
acactggctgttgtcagcggcctctgaggtttcaggctcttggcggtgaaggtcagagtgcagacctgagaccactgctcaccgacttcagactccagtttatctgtgccccagcttcctcacttagtctcagaagacttaggctgaggcctcagaaggagatctccatcctttgtccagagcagaacaggatggccatgtcccaggaatcattgaccttcaaggacgtgtttgtggacttcaccctggaggagtggcagcaactggactctgcccagaagaacctctacagggatgtcatgcttgagaactacagccacctggtgtccgtggggtatctagttgcgaagccagatgtgatcttcaggttgggaccaggtgaagagtcctggatggcagatggggggaccccggtacggacctgtgcaggtgaggacaggccaggtgagtcaggccggggaaaggagaccaggttggttggtgagagcttggcctctgggatgtgctcaggagcccttctcagagcctcggacttgtggacatgcctaggctctgatgagcagaactgttgtcatgtccaaatga

SEQ ID NO: 146993 - DNA, 4020 bp, Homo sapiens
  Payload ID: 9075
  Gene Symbol: KRBA1
  Gene Name: KRAB-A domain containing 1
  Uniprot ID: A5PL33
  ENST ID: ENST00000319551
  CDS Start-End: 400-3492
ggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcctggtagagtgggcatgaaggcctcggaggcaactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggcagctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaaggactgagggctgaggcctgcgagtcagcccgtctcgggcagggtaggggagaagcgcccacccggagcctccatctggtcagcccacaggtgttcacctccagctgcgtccccgcctgccaccagcgggggttcaaagaccctggggccaccaggccaggagtgtggaggtggctcccagaggggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaaggaa

SEQ ID NO: 146994 - DNA, 527 bp, Homo sapiens
  Payload ID: 9075
  Gene Symbol: KRBA1
  Gene Name: KRAB-A domain containing 1
  ENST ID: ENST00000497895
  CDS Start-End: 218-527
cagaccctggctattatcctggagtgtgcgcctggaggcctaggtggggttaccaagtgcagggacagctaggctgtcccctctgggatggaacaaccaacccccccggagactgtgcctgcaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgagg

SEQ ID NO: 146995 - DNA, 3763 bp, Homo sapiens
  Payload ID: 9075
  Gene Symbol: KRBA1
  Gene Name: KRAB-A domain containing 1
  ENST ID: ENST00000496259
  CDS Start-End: 45-3239
cccgcgccggaaaccgaggagtggcggggaggctgagcccggggatggcgcgccaggtgtccatcaccttcaaggacttggccgtgcggttctcggaggaggagtggcggctcctggaggaggggcagagggagttctaccgagacgtgatgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaaggactgagggctgaggcctgcgagtcagcccgtctcgggcagggtaggggagaagcgcccacccggagcctccatctggtcagcccacaggtgttcacctccagctgcgtccccgcctgccaccagcgggggttcaaagaccctggggccaccaggccaggagtgtggaggtggctcccagaggggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaa

SEQ ID NO: 146996 - DNA, 699 bp, Homo sapiens
  Payload ID: 9075
  Gene Symbol: KRBA1
  Gene Name: KRAB-A domain containing 1
  ENST ID: ENST00000467333
  CDS Start-End: 1-502
ccggggagccagcctggatggagagagagcgagccccgaggctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcagtgagtctgacacagcagggacagggagaaccagcatttcaaaagccctgatcgtggcgtcagaggacctggaccctgtgccctcttcatttttttctaggactcagttcccctgttgtgctgttcttttgttaacaaagtacgccagggagcaggacaacatatttagcctctggtgtaaccaccaaagaggaggcatgatgctcagcccctggggagcctgtcatcccgccccgatcactgagcactttgtacacagaaagtctccggcagtttctaacatgcaggcccacggccagcagcattgacctacctgtgtgcactggtctgatccttagaccgtctcatcacagcaaccctaactgcagagcagggcaaggggagctcctaggatttctctggggtctcattttatttttaaaacttctcacaaattttgcatgtctgtttttataaaaaagtacttcaaatttatatggaataaaattggcactcccaaagagca

SEQ ID NO: 146997 - DNA, 596 bp, Homo sapiens
  Payload ID: 9075
  Gene Symbol: KRBA1
  Gene Name: KRAB-A domain containing 1
  ENST ID: ENST00000486744
  CDS Start-End: 491-596
gtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccagctctccgccgccggtacccacggcccagtctccacctggggaaacccccttggcgtggcttgtttcgttacaagttatcctggtagagtgggcatgaaggcctcggaggcagtgtccatcaccttcaaggacttggccgtgcggttctcggaggaggagtggcggctcctggaggaggggcagagggagttctaccgagacgtgatgcgggagaactacgagacgctggtctctgtggagcctggaagagctgttgggggagggagccacgctgatgaggggcaggagcctgctggttgtggagatcccc

SEQ ID NO: 146998 - DNA, 3434 bp, Homo sapiens
  Payload ID: 9075
  Gene Symbol: KRBA1
  Gene Name: KRAB-A domain containing 1
  Uniprot ID: A5PL33
  ENST ID: ENST00000485033
  CDS Start-End: 1-2910
atgcgggagaactacgagacgctggtctctgtggggacagctgagctgctccccctctctgctttcctgtcaccctcagagcctggaagagctgttgggggagggagccacgctgatgaggggcaggagcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggcagctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaa

SEQ ID NO: 146999 - DNA, 3449 bp, Homo sapiens
  Payload ID: 9075
  Gene Symbol: KRBA1
  Gene Name: KRAB-A domain containing 1
  ENST ID: ENST00000621069
  CDS Start-End: 1-1853
agcctgctggttgtggagatccccaggggggacagccccggcacagcctgcacctcacagccctggtgcagctggtgaaggagatcccagagttcttgtttggagaagtcaagggcgctatggacagccccgagagcgagagccggggagccagcctggatggagagagagcgagccccgaggctgcggcaagagagccctgccctctccgaggcctgctcagctgccttccagacggccctaccagccagccccacctggccaccacgcccaccgacagctcgtgttccagtggcccaactggtgacggggtccagggaagtcctctccccatcaaaactgccgacaaaccgtggcctacaaggaaggaaggcccaggagccctgggcggggagcccagccctcccacccatagccccagcaggaggaagagccacagaggacaggagagagggacctcagaggccggaatttctcctgggaacagccccttgcaaggcctcatcaactgtctgaaggaaatccttgtgcctgggccccggcaccccgagacatccccaagcttcttgccacctctccctagcctgggcacgtccaggctaaccagagcagacctggggcctgggagcccgccctgggcagtgaagaccgaggcggtttcaggggattgtcccctccagggtctgctacactgtctgaaggagctccccgaggcccaggacaggcatcccagtccctcaggagtggggaaccgacggctacaggagaatccaggagcctggaaaaggggttctggagggcctggatacctcctgacccctcctccccatcctgatcttggagctggcggtctgctctctgtgaagatggagaacagctgggtccagagccccccaggacctgcatcctgtcagcctggcaggcagcccctcagtccctcagccactggagacaccagaggggtcccccaacccagctggggccctgaggctcaagctgccagtgcctcaagctcaccgctggaagccctggaagcctgtctgaagggcattcccccaaatgggtcgtcaccttcccagctgccacccacttcttgttcccagaacccccagccaggagactctaggtctcagaagcctgaactgcaaccccacagatcacacagtgaagaagcgaccagagagcctgttctgcctctgggtctgcagagctgtgtgagagatggccccagcaggcccctggccccccgaggaacccccaccagcttctcctcatccagcagcaccgactgggacctggattttgggagtcctgtggggaaccaggggcagcatcctggaaaaggaagcccaccaggaagctccccactgcagggtctggagaattgtctcaaggagatacctgtgcctgtgctgcggcctgcctggccctgctcctcagcagcagacaggggaccgaggagagcagagcccaggaactggacagcagacaaggaagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccaggagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtgagcctggggtctcctgagggggcgcccatgcgttccccagaggaccaggagtccagactggatcctttgagtcctgcctgtcgctttgcctggctcttgccagggagtcctgcacattggccgtgctttagttccctgtaaggtacagctcaggatccctgcccggtttctcagctggagaaaaggcccagggttagtgaagcatccagaggcctggagcttggacatggaagacccagagttgcagccaagacccatgagaggctgctcccccagggcccgcctgagctgcccagtgagtctccccctccggagctgccccctccggaagctgcgcctcctgtgttgccagcctcctccctgcagccgccatgccactgtgggaagcccctgcagcaggagctgcacagcctcggtgctgcccttgcggagaagctggatcggctcgccacagcgctggcaggcctggctcaggaagtggccaccatgaggacccaggtgaatcggctggggaggcgcccccaaggccctgggccaatgggccaagcttcctggatgtggaccctcccacggggacctcgctgggctcatggccctggtcacagacatctgccctactggaggcagaagggacccacgaggcctaaaccaaagatcctgcgtggccagggagagagctgcagggctggtgacctgcaaggactctccagagggaccgctcgccgggcacgtccgctgcctccagacgctcccccggcagaacctcctgggctccactgcagctcttcccagcagctgctgtcctctacacccagctgccatgctgcgccgcctgcacaccccctcctcgcacataccgggggccaccagagcccccttccccctttagtgcctgctgccttacccctgcagggagcctctcctcctgcagccagtgcagatgcagacgtgccgacctcaggagtggcaccagacgggatcccagagcggcccaaggagccgagcagcctgctgggaggagtgcagagggccctccaggaagaactgtggggtggggagcacagggacccgagatggggggcgcattgatggcattcctcttctccacatctgctcgttcttgccgagggtgcagtggtggcgtggaagccctgtcaccccaccccaggccaccctctcccagaggacgccatctcccttactgttgctgggagcctcgccctttgtcccaactgggtagagcccccaggtgctgtttgctcaggaggctgctgtgggggtgccttcctcagcctctggccctcttggctcagattcaatcaaatgttgcttccctctcctgtctttcccactggagccgcccaagcttgtaggtgggtggtgtgcataggccacgtgtgccccacatatgcagggggtgccccacacagctagagcggccaggagagcgcctcctaaccaccagccgttcctgatctcaggagccttgaagggctgggctcttgccttcctggagtaaatattggcacagatttcatttgagagaactcagccccctggtctaagctggacttacctctgtggattctgaaattaaagaagtgagttgctaa

SEQ ID NO: 147000 - DNA, 1964 bp, Homo sapiens
  Payload ID: 9076
  Gene Symbol: KRBA2
  Gene Name: KRAB-A domain containing 2
  Uniprot ID: Q6ZNG9
  ENST ID: ENST00000331336
  CDS Start-End: 7-1485
tgctgcatgccttcattcctggtgccctctcttgtctcttccccagtcctgctgaagctgctctttagcccaggccccaagactatatggtccctgtggcagcagccaatgttgtttcaggaagcaacagcatttgaaaatatgaccaaagattggaattatttagaaggctctcaaaaggattgctacagagacacaatgctggacagttatgagaacacggtcccacagggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccaaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctc

SEQ ID NO: 147001 - DNA, 2562 bp, Homo sapiens
  Payload ID: 9076
  Gene Symbol: KRBA2
  Gene Name: KRAB-A domain containing 2
  ENST ID: ENST00000396267
  CDS Start-End: 833-2065
gtggggcggagttgctgctcgggggcctctgggtggagggggattcagacgccgcgtctggtgtgtccctttctccttcctgaccttcctcagtctgcagctcttttctccaccgcgcgcccgcctcagccgttcagccctgagctggcgggtggacgggcatggatccaggcggtgggagcagtctgcgaagtcagggtaggaaggctacacaaaggaggcgacatcccagcccggtcctcaggaataagcgggcgtgcccgtgtggtgtggacggtgaggggacactgtattaagtgccttatctgcattatcattgaatcttcatagcaatcgattgtgatgggtactggtcatctccccgggttgtagatgaggaaactgaggcctcagtaactttgctttagtcagtaaatgataagagtcagcaaatgaattcccaagcgtagactcggccgtaccgctgctctaccttgctaataacgacctacctgtaagcgacatttttgacaaaatgtcctttaaacatcttttgtgctcagctctgtattcgtgggccctccaaagggggtacaggcaggtagaagcctccgtccctaccttataggttgtatatatctgaactggtcgactaaagatgcaaagcgaagtgctccagtgagtgtggtacaggttgttgagatgaaggagagatggcaatcagctaaagttactgaatacgtcaggaaggaggctggtttcagctggctgtgattgggaggatcaatgcgaggacattccgagtcggaaacagccaaggcgaagactcacaggatccttcttacagctctccatgatgcctcagagagctggaaatgatccacctggggtttcaaatgcaagtgaaatggaaatggagataagtaacatgagagaaaagtttcttatgagtgtaacaaagttagtagaaagcaaaagttacaacagcaaggtattttccaaagaaaagtactttcaaacaataaaggaagttaaagaagctaaagaaaaagggaagaagtcatcacgtgattatcgccgtgcagcaaaatatgatgtgatctctgtacagggcacagagaaactgatagaggctactcatggagaacgtgatcgaatacggtattatgtacataaggaagagttgtttgatattcttcatgatacacatctcagtattggacatggtgggcggacacgcatgctcaaggagctgcaaggaaaatatgggaatgtcaccaaagaagttattgtcttatatctgactctgtgtaaacagtgccaccagaagaacccagtacccaagagaggccttgcaccaaagcccatgacttttaaggacatagactccacatgccaagttgaaatacttgacatgcagtccagtgccgatggtgagttcaagttcattttatactaccaggatcactcaaccaagtttattattttacggccattaagaaccaaacaggcccatgaggtggtcagtgtcttgttagatattttcacaattcttggtacacccagtgtgttagactctgacagtggcgttgagttcacaaaccaggttgttcatgagctcaatgagttgtggccagacctaaagattgtatctggtaagtaccaccctggccaaagccagggctccctggaaggagcaagccgtgatgtaaagaacatgataagtacctggatgcagagtaaccactcatgtcactgggccaaaggcctccgattcatgcagatggtgaggaatcaggctttcgacgtttccttgcagcaaagtccatttgaggcaatgtttggctataaagccaaatttgggctatattcctcaaacttgccccgggaaactgtggctactttacaaacggaagaagagctagaaattgctgaagaacagctagaaaatagcctttggatcaggcaggaagaaagggctgagattggagcagacagatctgatatggacgatgacatggatcccactcctgaagcttcagaacccagcacctcacaagggacttccggtctcctctgctggtgaacagatggctgctgggtggacagtcacaggtgtctctctgagcatagtcatctgagaactgttgccagaggccccagaggaaaagattgaaggctgcactctcaggtcaagttgtacatggcagtccttgctcaaaaagacaaaagttcaggtctgtgtatttattcttagggctgccataaaaaattaccacaacctggccgggcgcagcgctcatgcccgtaatcccagcactttggtaggccaaggtgggcgggtcacttgagatcaggagttcaagactagcctggccaacatgatgaaaccctgtctctactgaaaatatagaaattagccaggcttggagctgtgtgcctgtaatcccagctaaccaggaggctgaggcaggagaatcacttgaacccaggaggcagaggttgcagtgagccgagaccatgccactgcactccggcctgggtgacaaagcaagactctgtctcaaaaaaaaaaaaaaaaaa

SEQ ID NO: 147002 - DNA, 3023 bp, Homo sapiens
  Payload ID: 9077
  Gene Symbol: KRI1
  Gene Name: KRI1 homolog
  Uniprot ID: Q8N9T8
  ENST ID: ENST00000312962
  CDS Start-End: 21-2150
ttcctcaatgcgcgtgcgcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgtttgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgtatctttcccctca

SEQ ID NO: 147003 - DNA, 885 bp, Homo sapiens
  Payload ID: 9077
  Gene Symbol: KRI1
  Gene Name: KRI1 homolog
  ENST ID: ENST00000432197
  CDS Start-End: 295-885
aatgcgcgtgcgcaatgggccacagaaccgccatgccggaaccgcgcgggtcgtcgcagctgcgggtgaacgcggcgtttgccgcgcggtacaaccgctaccgggagcgcgaggaactgcagcggcgaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcg

SEQ ID NO: 147004 - DNA, 571 bp, Homo sapiens
  Payload ID: 9077
  Gene Symbol: KRI1
  Gene Name: KRI1 homolog
  ENST ID: ENST00000543682
  CDS Start-End: 1-571
acagaaccgccatgccggaaccgcgcgggtcgtcgcagctgcgggtgaacgcggcgtttgccgcgcggtacaaccgctaccgggagcgcgaggaactgcagcggccatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaa

SEQ ID NO: 147005 - DNA, 514 bp, Homo sapiens
  Payload ID: 9077
  Gene Symbol: KRI1
  Gene Name: KRI1 homolog
  ENST ID: ENST00000544397
  CDS Start-End: 1-339
agaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacga

SEQ ID NO: 147006 - DNA, 582 bp, Homo sapiens
  Payload ID: 9077
  Gene Symbol: KRI1
  Gene Name: KRI1 homolog
  ENST ID: ENST00000539027
  CDS Start-End: 1-582
ccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagaagcccgtgtttgaacccggggacaagacgttcgaggagtacctggatgagtattaccggctggactacgaggacatcatcgacgacctgccctgtcgcttcaagtaccgcacagtggtgccctgtgactttggcctcagcactgaggag

SEQ ID NO: 147007 - DNA, 2719 bp, Homo sapiens
  Payload ID: 9078
  Gene Symbol: KREMEN1
  Gene Name: kringle containing transmembrane protein 1
  Uniprot ID: Q96MU8
  ENST ID: ENST00000327813
  CDS Start-End: 14-1492
gcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgcaattcaggactcggaagtgacatcactcatctggtctcaggggcagcccagaagtatctgactgtagacacaactaggctccgtgggcatatctgggtggcaatttcagagggcagaggggacaccttcattgcctctcctcgcacagaaatggtgggctctctctggcccagcgtggtggttcatgcctgtaataccagcgttttgggaggctgagatgggaggattgcttgagcccaggaggtcgaggctgcagtgagctatgatcacaccaccacactccagcctgagcagcagagcgggacctcgtctctaagaatagaaagaaagaaagagaaacggtgtcctccgcacagccggtcagaactgtgtgactcacttgaggcaggaccgagagtgacatccagttgcacctttctcacctactttgggacctttgggggtgagttcccctttgtcctctcgtggaaacagcacacagcaagcaaccacaaaaccagagcggaaggagggacttcccaccggcatccggccccagtgccatgttttatcatctggaacggttgtgaagctttgtgtgacttgctcaggatcagcagtcaccatggtctaatcccaagagggactcgtcacccagagacctcaaaaggccccaggcctactgtggttttttctgagaggctcccagaaccaagtggcacgttggtttcctgtgcgtctgtgtctttgtgcctgtatctcgctgggggacttcacaggaagcaggatttgggcattcctgaagctcccagctggacaccactcctgagcgccacatcccatgatcacttcaaccacaggcctttgactttgccacatggcaaggcacccagcagaagatgaggatgacgggtgatgctagatggatgtgtacctggtggatggcccacgcacgaagactcaagaccctcaggactggccatataatctgcaaggtccagtatgaaataagaataagcagcccacacaactgggcatagtggttcatgcctgtaatcccagcactttgggaggctgaggagggtggatcacttgaggccaggaattcgagaccagcctggccaacatggcgaaaacccatctctactaaaaatacaaaaattagttgggcatggtggcacacacctgtaatcccagctactcggaggctgaggcacaagaattgcttgaacctgggaggcggaggttgcagtgagctgagataacgccactgcactccagtgtaggcaacagagtgagaccctgtctc

SEQ ID NO: 147008 - DNA, 6138 bp, Homo sapiens
  Payload ID: 9078
  Gene Symbol: KREMEN1
  Gene Name: kringle containing transmembrane protein 1
  Uniprot ID: Q96MU8
  ENST ID: ENST00000400335
  CDS Start-End: 54-1430
cgcgctgccccctttaccccgggccgcgccccggggccccgcactgacggcccatggcgccgccagccgcccgcctcgccctgctctccgccgcggcgctcacgctggcggcccggcccgcgcctagccccggcctcggccccggacccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaaaaaccccactgtgcctaggacttgaggtccctctttgagctcaaggctgccgtggtcaacctctcctgtggttcttctctgacagactcttcccctcctctccctctgcctcggcctcttcggggaaaccctcctcctacagactaggaagaggcaccctgctgccagggcaggcagagcctggattcctcctgcttcatcgattgcacttaggagagagactcaaagccctggggcccggccctctctgcatctctctctgatctagctagcagtgggggtgtcaggacagtgaggctgagatgacagaggtggtcatggctggcacagggctcaggtacattctagatggctgtcaggtggtgggtagctttagttacattgaatttttcttgcttctctatttttgtccacacacaaatcagtttctcctgatctttatgtcttggaacagggccagacagggagaactctcaggtactcttgggagttggtcccatacaagtgcggactcctggacattagcgaggtgtaaagagggcagtgtctgtgctgccccggcagctttgctctccagatgctggactagggtgggcctccttcagcctgggagggtctgagaataagatctagtgacccccatttatatcaaacctgataccttacacatgggcttctttctagattcttctttccatagctcatggagctgcagggaaagctttaagagctttggtcatataaaacatccattcagctgggcgcgatggctcatgcctgtaatcccagcactgtgggaggctgaggcgggcagatcacctgaggtcaggagttcgagaccagcctggccaacatggtgaaaccccgtctctactaaaaatataaaaattagtcaggcgtggtggcaggcgcctgtaatcccagctactcagaaggctgagacagaagaacagcttgaacccaggaggctgagattgcagtgagccgagatcgcaccactgcactccagcctgggtgacaagagtgagactctgtctcaaaaaaacaaaacacaaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagatggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtgggtttgggaattggagctcctccaaggagctcctcctaagattgagtgctgcagctgtagtggctgctggttgggagagtaagtgccatcactaatttaaaagtccttgccatctggaatcaggctttgtcaacagcagctgagaaaagcagcctgtgcctctgctggccaggcctaggccctcgtcagagcgtgcctctccacaaggcacttgggcctgggtgattgttgcgcctctggctttggcgtttcctctttgcagcactttgcctacctcccccaagccctgagccactgcctgctggggctcctactgaggttctggaaacacctctgcacctgccgcccctgggaggaaagagggccacacaggaagtgtctgcagggagaggtggcactcggcagcctgagttcaggagaggtgcttggagcttcaggcagaggggccttcagaggagggaaacggagcaatgtgtcacaggcaggcaggggcaggactgccaccccaggccccgtgggaggcctgctgagggcacagagctgctcggtgcagccttcatgctttgatctggaaagagcagctgtccgcaggcctctgtctccaagaggcctgtcacacaggaggaccgctggaaacataccaacacgtgcagtctcccctccaagctattcatgctgtttgtggaatctctctcaaacataagtgtcaggtgtgtgtcgtcccaacgggtcctgtgctgtgaatagatccatgtgcagcacaaagggaatgtggcacgtggccccaggaagagttcacccggccagggggcagttgttcagttgcctggggctgacactgaccactggcctctggggtgtcctgcagcccaaatgcccaccttgccctcctcacatctcagtcaggggaggccatgcccaagccaatgtgctgtcacagcctgcagcgggggcagcacttcctcggagggcctgggaggtgctggggatgccccagcgcttctcttcctgcctcgccctggcatggcccagcgcctctaggatcaacttacgatccgtggagcagccccgggaaacccaaatctggctcaggacagcgtacgggcaggagggctgtaaatcatcccaggctaagcctccgtgggcactggctcctgccgcagcctggctatggactcagttagaaccaggtagaaagtcagcgacaccccacagaaggccactgcggctaggtaaacacctgagaaagaaactgctccagaagagatgacgtgggcttccaggagcatggaggaggtggcacttgaacttttaggaaactccttagatgagataaagtgggggttggaggtggcgaaaagagggtaaccctgggaaagtcagtcagaacccatggcagaagactgcaggagaggcaggggaggggcttcggggaccactgtggacagagctctgaaagcaccctggccaaagcccctcctgaggtgacagagcgtgggaggaggctgcactgggcctgcgtgccatcctcacccctgttccccgctggcgccaggccctgccttcttggtacctgtgccaacaggagagccctcaccagccgatcttgtcactctccgtggtgacagtgtcttggccagctgtggcccctagtttctagcagcgtttctcagtgtccttggcccttctgagaaggcaggcgggaggcacacggtgccctgttcttccccgtttgtccagttgcttgcaaagcagagaatgagtaggagtgaacccgagtgacttcacccgccctgtcccccacgtcaggacaggcttgaggcctctctgggcgtgagcgaggaaaccaggctgctctaacttctgaagagtgggctctggctcaagactccaatcggccagaagcccacagagatcaaagcactagcaagttcagctgtcctggccctcgggtagaacccacgggcgtgcctgggtgcggctccacccacatgccccactgtcagcccaggcaggagccttcctggccgggctcaggatctgcctgcagcccagccaggccatcacccagccccgatgcatcctggcactgcacgcttactcttcacaagcacttatacgcggatggcctccgagaccctgcctccctggtctgctgaggtcaggccaggtctcccacggagccgggcagctccacaccccaccacctggcaccgttaggtttcagatctcccgtgtggtgtttgatgtcggcttttgttcctaccttgggagtttggattgtttcctctggtgtctttgtttaccttcctcactgttctacctcctggccaggtctcagcttagcttccctggtgtggggtgtttttcaagccttccagccacagctgtctcccctcaggctggacggctccggggtgacagggcttcaccctctgcctgcagacccctggtgggcacatctcacaggcttccgtcttgctgagttgggtacggaggcagaagtggggtgtggaggaaagtcagagggaaatctgcttcagaaaggaagggtctttagacacaaagactggaggcccttccccgcccgcacgggagctgccatcgtgggtctcatgcacgtcaagaccttcccacatccaaactcagcttccagcagggattttgactttggatgacaaggctttatttgtaaatatgctcttaatatgcaactttgagaataaaatagaaacatcatgtattttaaaatataagatgaagtgtgacgcactgtatacaatttaatatatatttttagggttttgttatttaagaaaatggaatgtaatggtacttttacaaacgagaaaaaatgttatttttactttctggaaaaaataaatattctcattgttgtagaaaga

SEQ ID NO: 147009 - DNA, 1422 bp, Homo sapiens
  Payload ID: 9078
  Gene Symbol: KREMEN1
  Gene Name: kringle containing transmembrane protein 1
  Uniprot ID: Q96MU8
  ENST ID: ENST00000407188
  CDS Start-End: 1-1422
atggcgccgccagccgcccgcctcgccctgctctccgccgcggcgctcacgctggcggcccggcccgcgcctagccccggcctcggccccgagtgtttcacagccaatggtgcggattataggggaacacagaactggacagcactacaaggcgggaagccatgtctgttttggaacgagactttccagcatccatacaacactctgaaataccccaacggggaggggggcctgggtgagcacaactattgcagaaatccagatggagacgtgagcccctggtgctatgtggcagagcacgaggatggtgtctactggaagtactgtgagatacctgcttgccagatgcctggaaaccttggctgctacaaggatcatggaaacccacctcctctaactggcaccagtaaaacgtccaacaaactcaccatacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgatactctcgtgggcgcctgcggtgggaactactcagccatgtcttctgtggtctattcccctgacttccccgacacctatgccacggggagggtctgctactggaccatccgggttccgggggcctcccacatccacttcagcttccccctatttgacatcagggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctcagactgtcccaggtagcaattcctgggcgccacccatgggggctggaagccacagagttgaaggatggacagtctatggtctggcaactctcctcatcctcacagtcacagccattgtagcaaagatacttctgcacgtcacattcaaatcccatcgtgttcctgcttcaggggaccttagggattgtcatcaaccagggacttcgggggaaatctggagcattttttacaagccttccacttcaatttccatctttaagaagaaactcaagggtcagagtcaacaagatgaccgcaatccccttgtgagtgactaa

SEQ ID NO: 147010 - DNA, 516 bp, Homo sapiens
  Payload ID: 9078
  Gene Symbol: KREMEN1
  Gene Name: kringle containing transmembrane protein 1
  ENST ID: ENST00000453585
  CDS Start-End: 1-248
tacaaacttgcatcagtttttgtcggagtcagaggttcaagtttgctgggatggagtcaggctatgcttgcttctgtggaaacaatcctgattactggaagtacggggaggcagccagtaccgaatgcaacagcgtctgcttcggggatcacacccaaccctgtggtggcgatggcaggatcatcctctttgataggactcggcggacatggtggagcttctggatggctacacccaccgtgtcctagcccgcttccacgggaggagccgcccacctctgtccttcaacgtctctctggacttcgtcatcttgtatttcttctctgatcgcatcaatcaggcccagggatttgctgttttataccaagccgtcaaggaagaactgccacaggagaggcccgctgtcaaccagacggtggccgaggtgatcacggagcaggccaacctcagtgtcagcgctgcccggtcctccaaagtcctctatgtcatcaccaccagccccagccacccacctca

SEQ ID NO: 147011 - DNA, 2326 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000303746
  CDS Start-End: 578-1966
ccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgctgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggta

SEQ ID NO: 147012 - DNA, 1882 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000319500
  CDS Start-End: 210-1472
agagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgg

SEQ ID NO: 147013 - DNA, 1798 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000575885
  CDS Start-End: 247-1392
agattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggt

SEQ ID NO: 147014 - DNA, 2339 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000572045
  CDS Start-End: 306-1505
gtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggtgaggcgggcgcgcgggacgggagtgagtcagggagccgccccctcgcgcccatcctcaccgcagccgtgtgcccgcagcccgggtcttctcgacggtgacggctgtctcggtgctgctgctgctgctcctggggctgctgcgtccgctgcgccgacggtgcggggcgctggggcagggcctgagggcggaccggtggtggggagctggagccccagaagggaacagagctaggaaggaactcctgggttcttaagggagcgaggctttgggtccacgcacaggatcgcgcgcgggatcgcaggtagagcaggacgctgcagcgggattggaccggctcggctgatgtctgctccctctctaggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggta

SEQ ID NO: 147015 - DNA, 1922 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000575769
  CDS Start-End: 1-1275
atggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgctgcgccgacggtgcggggcgctggggcagggcctgagggcggaccggtggtggggagctggagccccagaagggaacagagctaggaaggaactcctgggttcttaagggagcgaggctttgggtccacgcacaggatcgcgcgcgggatcgcaggtagagcaggacgctgcagcgggattggaccggctcggctgatgtctgctccctctctaggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccc

SEQ ID NO: 147016 - DNA, 1877 bp, Homo sapiens
  Payload ID: 9079
  Gene Symbol: KREMEN2
  Gene Name: kringle containing transmembrane protein 2
  Uniprot ID: Q8NCW0
  ENST ID: ENST00000571007
  CDS Start-End: 247-1518
agattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgctgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggt

SEQ ID NO: 147017 - DNA, 4553 bp, Homo sapiens
  Payload ID: 9080
  Gene Symbol: KRIT1
  Gene Name: KRIT1, ankyrin repeat containing
  Uniprot ID: O00522
  ENST ID: ENST00000340022
  CDS Start-End: 1020-3230
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataa

SEQ ID NO: 147018 - DNA, 2827 bp, Homo sapiens
  Payload ID: 9080
  Gene Symbol: KRIT1
  Gene Name: KRIT1, ankyrin repeat containing
  Uniprot ID: O00522
  ENST ID: ENST00000394503
  CDS Start-End: 398-2464
atagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaagtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctc

SEQ ID NO: 147019 - DNA, 3143 bp, Homo sapiens
  Payload ID: 9080
  Gene Symbol: KRIT1
  Gene Name: KRIT1, ankyrin repeat containing
  Uniprot ID: O00522
  ENST ID: ENST00000394505
  CDS Start-End: 555-2765
agcgatttcatagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaa

SEQ ID NO: 147020 - DNA, 4762 bp, Homo sapiens
  Payload ID: 9080
  Gene Symbol: KRIT1
  Gene Name: KRIT1, ankyrin repeat containing
  Uniprot ID: O00522
  ENST ID: ENST00000394507
  CDS Start-End: 785-2995
gctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccacataacactgttatttaaaacagttttctgcagtctataaacatttctcaacatttttttaaaagtcttagttaaaatgtaaatctgatatacagtagtgtttctcaaagtatagttcatgaactccttgcatcataattacctagatgcctcttaaaaatgaagatttcagagacccattctaaacaagggcattcactctctggaagtagcatggccttgtgaacttaaatttggttttgttttttcttttttgctgttagaataatttcagacccaataaggaatttcgattattaaagttgagaaatttcacaaaactgcctggcacacaagcacacacatacatagacacattttaagtgataatctcttgatattagaagttgcatttgttaaatacatgctgtattttttatgagttgacttaatagtttatgtatattgactttgctttgtaggaagtaaatcaccagatatcttattgtttcatttaggaaagtagtgatatagatgaagagccaacttgatgaatgtgctattcataagctagaaactacagtttttccaaactaataaactgatgaattctaaataagttcagagatatagtcatatttaaagttgtcctacagtttgcagataatttttatattactattcttcacattaacttctgcttatttttaatggtactatatgtaggccttattaaaattaagattgtatggttaagtaaagttaacaagaaagcctgatttatctttaattctgtgctaggtacttttgattctacatgaacaatacccttttcagttcccttcattctaatgtcctcaactgttaccaaataccctgttgactcccaaacctaagattttagcctcaacttcttttctgaacttcaaatcttaatttccaagttatacttgttctaggtccatctaaatggtctacagagaacttcagttgaatcatagctggaaacagaatttatttcctctatttgcttcattctgtccttccactatattccctattt

SEQ ID NO: 147021 - DNA, 783 bp, Homo sapiens
  Payload ID: 9080
  Gene Symbol: KRIT1
  Gene Name: KRIT1, ankyrin repeat containing
  ENST ID: ENST00000444960
  CDS Start-End: 682-783
tcatgttccagccttgcgcgctcgcagccccggccgccctcttcccctcccccgcctccggctccggctccggctcagccgctggcacccccaccgccaccaccctagtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaa

SEQ ID NO: 147022 - DNA, 702 bp, Homo sapiens
  Payload ID: 9080
  Gene Symbol: KRIT1
  Gene Name: KRIT1, ankyrin repeat containing
  ENST ID: ENST00000430102
  CDS Start-End: 410-702
acctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcc

SEQ ID NO: 147023 - DNA, 1472 bp, Homo sapiens
  Payload ID: 9080
  Gene Symbol: KRIT1
  Gene Name: KRIT1, ankyrin repeat containing
  ENST ID: ENST00000458177
  CDS Start-End: 744-1472
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgg

SEQ ID NO: 147024 - DNA, 665 bp, Homo sapiens
  Payload ID: 9080
  Gene Symbol: KRIT1
  Gene Name: KRIT1, ankyrin repeat containing
  ENST ID: ENST00000452773
  CDS Start-End: 492-665
catagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaactt

SEQ ID NO: 147025 - DNA, 483 bp, Homo sapiens
  Payload ID: 9080
  Gene Symbol: KRIT1
  Gene Name: KRIT1, ankyrin repeat containing
  ENST ID: ENST00000422347
  CDS Start-End: 409-483
acccggaagcgatttcatagccacgcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattct

SEQ ID NO: 147026 - DNA, 557 bp, Homo sapiens
  Payload ID: 9080
  Gene Symbol: KRIT1
  Gene Name: KRIT1, ankyrin repeat containing
  ENST ID: ENST00000440209
  CDS Start-End: 222-557
atagccacggtaacggcggggtggaaagctaaggcctttgaagacctgggaccccgtagtttcgggagaggttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttatt

SEQ ID NO: 147027 - DNA, 507 bp, Homo sapiens
  Payload ID: 9080
  Gene Symbol: KRIT1
  Gene Name: KRIT1, ankyrin repeat containing
  ENST ID: ENST00000458493
  CDS Start-End: 311-507
gcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacaca

SEQ ID NO: 147028 - DNA, 561 bp, Homo sapiens
  Payload ID: 9080
  Gene Symbol: KRIT1
  Gene Name: KRIT1, ankyrin repeat containing
  ENST ID: ENST00000445516
  CDS Start-End: 68-561
tttattccagctttattccgaccttctcctcttgagcggataaaaactaatgtcataaatcctgcatatgctactgaatcaggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaa

SEQ ID NO: 147029 - DNA, 546 bp, Homo sapiens
  Payload ID: 9080
  Gene Symbol: KRIT1
  Gene Name: KRIT1, ankyrin repeat containing
  ENST ID: ENST00000425073
  CDS Start-End: 512-546
agccacggtaacggcggggtggaaagctaaggcctttgaagacctgggaccccgtagtttcgggagagggtgaggggtgaatggtgctgaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgt

SEQ ID NO: 147030 - DNA, 978 bp, Homo sapiens
  Payload ID: 9080
  Gene Symbol: KRIT1
  Gene Name: KRIT1, ankyrin repeat containing
  ENST ID: ENST00000454017
  CDS Start-End: 492-978
atagccacggtaacggcggggtggaaagctaaggcctttgaagacctgggaccccgtagtttcgggagagggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagt

SEQ ID NO: 147031 - DNA, 855 bp, Homo sapiens
  Payload ID: 9080
  Gene Symbol: KRIT1
  Gene Name: KRIT1, ankyrin repeat containing
  ENST ID: ENST00000433016
  CDS Start-End: 303-855
gatttcatagccacggtaacggcggggtggaaagctaaggcctttgaagacctgggaccccgtagtttcgggagagggtgaggggtgaatggtgctgaggtgcgaggagagggaaggacagtaaagagcaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagc

SEQ ID NO: 147032 - DNA, 551 bp, Homo sapiens
  Payload ID: 9080
  Gene Symbol: KRIT1
  Gene Name: KRIT1, ankyrin repeat containing
  ENST ID: ENST00000413688
  CDS Start-End: 344-551
atagccacggtaacggcggggtggaaagctaaggcctttgaagacctgggaccccgtagtttcgggagagggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattgg

SEQ ID NO: 147033 - DNA, 3378 bp, Homo sapiens
  Payload ID: 9080
  Gene Symbol: KRIT1
  Gene Name: KRIT1, ankyrin repeat containing
  Uniprot ID: O00522
  ENST ID: ENST00000412043
  CDS Start-End: 790-3000
gagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctcaaaaaaaaaaaaaaa

SEQ ID NO: 147034 - DNA, 572 bp, Homo sapiens
  Payload ID: 9080
  Gene Symbol: KRIT1
  Gene Name: KRIT1, ankyrin repeat containing
  ENST ID: ENST00000425919
  CDS Start-End: 459-572
gcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcat

SEQ ID NO: 147035 - DNA, 3056 bp, Homo sapiens
  Payload ID: 9080
  Gene Symbol: KRIT1
  Gene Name: KRIT1, ankyrin repeat containing
  ENST ID: ENST00000611677
  CDS Start-End: 485-2182
tcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctc

SEQ ID NO: 147036 - DNA, 10118 bp, Homo sapiens
  Payload ID: 9081
  Gene Symbol: KRR1
  Gene Name: KRR1, small subunit (SSU) processome component, homolog (yeast)
  Uniprot ID: Q13601
  ENST ID: ENST00000229214
  CDS Start-End: 25-1170
ggagccaccggaagcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaagaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttttttttttggtggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttcttcttttgagtaagagtattgctataacatatatttttttctgaaatgttttaaaatagaagtacacctaattgttattggttaaaaaaaaagccatatgtgaatgaggttggtttttgggttttttctttcctgaattgtattagtccaaaagaactaaattagggtacttgtgctgtaccaaaatggtaattataacagacagtattagaattactgaattaacaatgagaaagagagaagtgtatctgttacgtggatatatgggccagcctggatatacaacagagtagtaacctgtgaaacaaacatagaatatcctcttagacattgttcctcataatgcactgacagaattcacatagctcttaatgaaacaatttaagattgatgtacgtacgtttgacttggtctcgctgtcggttaactgtaaagttagggggaagaaagaaaaaaaattaaaagggtagacacagttgagagttttattttaaaaagctaagtcttataattatgaccattaacttgctttggctttattgcagtgactttccaagtttaattattcaaaactttttgaactgactgaattaacttggtatttttaagttgactttttacataaactttataaaccttttataaaaaggaaactataccattactataaatggaaaatcattttacacatcatacctagcaggtaataaaatttaaaaaataaaaattaaatattagaatgtgagaaatttattaaaatatagttctaaaaataagtttcttcctgagaagaatgatactgtttatgatgaatccatagtgaaaagacagtgacctctctttcatccagtctagtatatcactaaatcatcattacgatgtttggctatcaagtcattaattactgtcctcctttcactgagctttattcaaattttgacaatcagagcactgggaagaaataaattccacaactgcctttagccttctggatactttcttttataaaatagaaaccttttccacaccagttctgcagcagtcgctattagatgctcgtggtagaacccatcaatcatctggtcctctgggtactggtgagcatccctggtcttcatacctgtgagtgggctttgtggtgaattactgtaaatatgctaccctcacttttcttggcagttatgtcgatgaaatcaagagtgtgatgttctagttatttttttttatatatatttttaaatgttcaatattcaactattgaaacaaatgtacatctgtgaactagctaaaatcatcttatgtaccactaatatgcccagcacattttgtaaaacagtcctgatttggcctccaagggtatttattgaactaccagcagtatctaggagaccacgaaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattagtgacaagatcaatctgtaagatgttgagcacttatctgaagtaaatgggtaatgagtttcacatcttataaatacaagttagcatgtgttttctcaagagtccaagggttttcattattggactacagctttaatcttctaaatgttattccccaagattaaagagcatctcaagttagatcaccaaagatcaaaagctaaaaccagaagtatttttgtcattgtggtggtggtagtgttactaattgcctagatttttaaagggaaacatttttttcactgggttgtttcgttgaaaaaaatagaagcagaaacttgcccaaagtcacagtggtcaaactggaaattgcaccaaaacttggcatactggttctgaaatccatagttttagcccttatgtatactggttaatttggaaggaagaaatatatacgttctgaagtgaagagtgagtgaaaggaagaattcagtgaatacattgataccttgatattatctgcattgtggctacatgttacttttcttcacaagagtgatataagtgaaataaagaatgattggactgggagaaaaatggctcagaaaactttgcaaaagtacgactgtatgtaaagataagtattcaacattaaatgggaaggaggagagcaagcagtttaatatatagaattttataattttaggcctgcaagggaccttataaaacatgagcaatggaacacttttttccaaactaaatttcgtgcagtggaacttggccgactctgtccttcctctattctaagcaccctactctagcccggctgctctgagttcagtttgttacaaatatggacacgaaagtaccacaggctttgcacagcttaattgaagtttccccttcacaccatggtaaaaaaacatactgggatggaagggtttgtgtctagaacaagaacaagaaataaactcttggtcacttactaatatttcaaaatcacaaagcagaattttgcttggatgtttagtaaaacatccttggaaatttaactgcttgcagcttctacacttcttcattaaatgctgtctggctaataaaaagtgccatgttgcagctttattttattttcattttttggagatagaccctcactgtgtcacccaggctggagtgcagtggtacaatctctgctcactgcaacctccacctcctgggctcaagtgattgtcctgcctcagcctcctgagtagctggggttacgggcgtccaccaccacacccagctagtttttgtatttttagtagagggggtttttgccatgttggccaggctgggcatggtggcatggtaatctcagctacttgggaggctgaggcaggaggatcgcctgaacccgtgagatggaggttgcagtgagctgagatcacaccactgcactctagcatgggtgacagagcaagactctgtctcaaaaaaaaaaaacaaaaaaaaaaacgaaaacagaattctgtttgtttggatgacctgttatacttatttttgatcttgctgaaataagcaaatcttaggaatcttagtctacagtttctgacagttttttttgttgttgttgtttgaccaattagaactaaataaaaagaacgtgattttcacatttaaatttctcttaaatgtattcctagaacagtaagccattggtttaattgctacttgatgccagtttccttgaagatagccgttaagataaaacatggtttcattgttaattctgtagaaagttacatgttactattatgttattctattggtgtattgttccttttactcaccacagagattgtccaaacacttgtcattattggggcaggcactgcaggtggctcctctcttatatggccaagttgggtaattccctctgtaaagcagaagaaggatgtccattagaagtttttcggttttttaaaattgcaatttactatgaatccttaactaaatccagaagaatagtggagtgaagtacaaaggtccagagagttggtaatagaagtgaagacaggaaggcagaaatggaaggctgctaatatttgcatagttcattctatgtacctgtgtctatgcacctgttttaatctgcatcccatttaattgtgacagctctgagaggaagttattcttgttttacagatgagacaaaagatgtaagagatacctttaatcacaatttatacacttcagagtcagaggaaacctggatttaactccagggctgtgctccctctctttacctaccctctggcctatatgattactgccatttaaaaaactgtccatcttagaaaagctatggtgacccacattcaatattctcagttggtcagccctccataattttcactggataggagccatttggctggtgccttccaaaaaaataataaataatggtatgggggaatttctaaagtacaaattgttttcacatacaagatgtgatatgaataatagctgctaattagtgagcactaccatgtgcttgtctttgttctaaacaaccttgaatgaaataatcttcacaaaaaccctatgaggaagttactgttgtctatttatacccattatatagctagaggctgagtcacagagtataagtaattgaccaaggtcacagactagaaagtgaaataatatccaagcattttatatccccataaatatcctcatagtagtaatggggagagggggcacatttatctcaatgaacctgccattgcactaattttttttggaactctgcttttggaaaaagttctaaacttttttgtgtaatcgtaccctttggcagtctggtgaggcctatgggctctttctcaacatagtttgttgttaaatgcataaaatacataggattataaaggaaaccaattaaattgaaatagttatcaaaatgtttaaaacaagatttgtgataaagtaatatgtgcttctctattaagatctaccgggggctattagtttcaatgcagtgatgaacacaaactatattttgagttctctgcagcaagtggaatgtggtatgaaaatatctgatatttacaaagatgatactgctaagtcagagtcacgtttattgctaatatgatggtggagtgttgtcttcattcataatgaaaggaaatgttatttttaatagaggttagtgaaaataaaaataaaactattttctaatcaaagtttatggtcctcctctccccagcactctacaattacctccaaagttgagaactctcaccttagacacacaactttataacgataccttatttccaaccccaaatctatgttcttatctcattttgctccaaattttaagttgcttcagaaatttaattagccctctgcttactctacaccatggaaaaaaggtaatatagtagaaattctgatagcaatttcaaaagatgtccaaaatagacattaatcattggaatgtctttcattgttaataagcacagtattaagtggtttaagttctagaatgattttaataaagtcatttatgatacttagttgtgcattccaaactgtaaaggaaaaggtaaaaaatgctacttaaaaataagctaaaaaccaagacagtcggtgaggtctgtggaaatggtagtattcatcttgggagaaacatgctactggaaaggcctggatttgtctagatgggagtcattaagactgtgggacctaaagtattcagcacaataaagcaacaggacatttcaatgttttccctggtagcctgagagagaagagggttggggttatgggacccaggggaagaccgaagacaaatctttaaagaaaaagataaatatgggtaagggtccctaaggcagtgacggcctaagcacactggtactatcttgactatcttgtggtcaaagttatttcctcttctgtgctataatcctctcctccactaatccactctgagtaaagatctgttacacaccatacccttgttcatggtgcccaggggaaatgaagaggagagtattacaggcaactggaagattaagcatcccagaccccattctgaggtatcagaaatattgaggaggatactggacttcctaagattatgtggaatgggggcctacaactttttgtgtataggaaaataatacctcagagggcagagggcaaagggaaatgaggacattcctaactggtctctctgttttaccttttatgctcctctaatccattttccatccagactgatgtccaaatttaaaggtctcatcgctcccctgcttaatatacttgaatgacttcttatgtaaactttgtcatgatctaaaagttcccgctagatctgcaactgccttcctccccccgtttcatctgtttagcagaccgagggcaccagtctctgtggtttaaacttgccaaacttttcttcacggaagttttgctgttcttttctccactagacagctgttccagaagttcttatgtctgattccttctcattcttcatgcctaagcttaaatataacacaagaagcccttccctgattattctaaacaggggccttgcctattgatagtttctattacagtattatttatagttccttaattgccccataatgatgcagttattttacttgtatttttattatctgtttgccccataaatattactctcataaagacagagactgccctgttctcctttggagctcagtaaaacaaatatttgttgaataaatgaatatttgaagttagtctttatggaagcattataactttggttgtaagttttataatttaatattgtttataactctgaagataagtgagtctaaaccaggaaaatttacatttatactttaatgaataaaaatcatgaatacttacaaaacattcactattgccaagcattatatatacctagtattttacaaagccttctcttgtcactttcatagctactctaagtgatgggtcctgtaaccctgatctattggaggttaaactgagattcagagttaacttgtccagggtcacacagtaaattaattgtatcttaaccattaaaaatgtcatatgaggccgggtgtagtggctcatgcctataatcccagcactctgggaggctgaggcaggtggatcactttagcccaggagttggagatgagcctgggcaatatggcaaaactctgtctctacaaaaaaattaactgggcatggtggcatgtgcctgtagtctcaggtactaggaaggctgagttgggaggattgcttgagcctgggaggttaagcctgcagtgaaccgtaagcgagccactgtactccagcctgggtgacagagtgagagaccctgtctcaaaaaaaaaaaaaaaagtcatgaaaagttaccactaactgaattatggctttgtctagttttttctgggttttctttattttccaactcttaagatattaagtcaaagctgtcatcttcagaatgacgctttgtctcctccttcacacctacagcactcagtcagagtatcgagcatgtcttctgcacattacaccagggaaatggctttctttcagccaatctccaggaatccaaaaattcaaaggcaacaaattaaagatcattatatatattgcaaatggttaaaaacctttaaaatataaaaacttttataaataagaaaatctagtagaaaaatggtcagcccacatgattcacagaaaaaggaatataaatagacaattatgtgaagaaatttataattactagtaatcacagagatgcaaaagaaagcaaatgaaatgccatttccatcaaattagaaaatactaagaaattataatacctagtactgatggtgaaatacaaattgatataatggtggaatgtaatttggcaatatgtacttaaaacaaaaatggtcacagtctttacgtgctagtatctcaaggaattatagggaaatagaagtgactgaagatacatatatgaggttgttcatcatatattaaatgaaaatatagtgaacaatctaaattcttcaacaggatggtggtaccatcaagagcatggactctggagctagacagccagatcaaagtccatcagtgatagtcactaactgtagaactttgggcaggttgctgacccgtgtgtgccttgctgttctcatttgccaaacaggggtagtaataggagccatctcataaacttctggtgaagattaagttaatatatgtgaagcactttaacagtgctgagagcattgtaagcattatataaacaatctatcatttttatgattaaaatcacttaaaattttgaaaaggaaaatttttcacagcataattttaagtgaaaaatagaaaatgtatattttcagtatgatcagatttctaaatatgtgtatgacacaagcacacatatgtaagtttaaagaaagtaggaggaaggtgtttgccctgtttcccaaagtgggaactatatctgttttaaaaacaactgtcaaaagtaaatgaaataggttatataagttgaggaatctgttttgctttgaaaattgtgtaaaattgccaagtttctaataaaccaataaatataaca

SEQ ID NO: 147037 - DNA, 975 bp, Homo sapiens
  Payload ID: 9081
  Gene Symbol: KRR1
  Gene Name: KRR1, small subunit (SSU) processome component, homolog (yeast)
  Uniprot ID: Q13601
  ENST ID: ENST00000438169
  CDS Start-End: 1-975
atggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaa

SEQ ID NO: 147038 - DNA, 1130 bp, Homo sapiens
  Payload ID: 9081
  Gene Symbol: KRR1
  Gene Name: KRR1, small subunit (SSU) processome component, homolog (yeast)
  ENST ID: ENST00000612627
  CDS Start-End: 12-878
gcagcttgcaaatggcgtctccctcgctggagcggccagaaaaaggcgctggaaaaagtgaatttcgtaaccagaagccgaagccggagaaccaagatgaatcagaactccttacggttcctgatggttggaaggaaccagctttttccaaagaggacaatcccagaggacttttggaggagagcagtttcgcaactttgttcccaaaatacagggaagcttacttgaaagagtgttggccattggtgcagaaagccttaaatgaacatcatgttaatgcaaccctggacctgatcgaaggcagcatgactgtttgtactacaaagaagacttttgatccatatatcatcattagggccagagatctgataaaactgttagcaaggagtgtttcatttgaacaggcagtacgaattcttcaggatgatgttgcatgtgacatcattaaaataggttctttagtaaggaataaagagagatttgtaaaacgaagacaacggcttattggtcccaaaggatctacattgaaggcattggaactcttaactaattgttacattatggttcagggaaacacagtttcagccattggaccttttagtggcttaaaagaggttagaaaagtagtccttgatactatgaagaatattcatccaatttataacattaaaagcttaatgattaagagagagttggcaaaagattctgaattacgatcacaaagttgggagagatttttgccacagttcaaacacaaaaatgtgaataaacgcaaggaaccaaagaaaaaaactgttaagaaaaatatacgccattcccaccaccacaaccagaaagtcagatcgataaagaattggctagtggtgaatactttttgaaggcaaatcagaagaagcggcagaaaatggaagcaataaaggctaaacaagcagaagccatcagtaagagacaagaggaaagaaacaaagcatttattccacctaaggaaaaaccaattgtgaaacctaaggaagcttctactgaaactaaaattgatgtggccagcatcaaggaaaaggttaagaaagcaaagaataagaaactgggagctcttacagctgaagaaattgcacttaagatggaggcagatg

SEQ ID NO: 147039 - DNA, 1592 bp, Homo sapiens
  Payload ID: 9082
  Gene Symbol: KLF1
  Gene Name: Kruppel-like factor 1 (erythroid)
  Uniprot ID: Q13351
  ENST ID: ENST00000264834
  CDS Start-End: 42-1130
ggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataa

SEQ ID NO: 147040 - DNA, 3097 bp, Homo sapiens
  Payload ID: 9083
  Gene Symbol: KLF10
  Gene Name: Kruppel-like factor 10
  Uniprot ID: Q13118
  ENST ID: ENST00000285407
  CDS Start-End: 302-1744
acacgctccactgacaccagcttcacgctgccgggcagtcgccgatcacgcgtggccccgcgagcccattggccggcgcctcacacacctttgccgttgattggccggcctcaggctccgcccccacccccgcccgcggcgcggggcaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatgg

SEQ ID NO: 147041 - DNA, 3659 bp, Homo sapiens
  Payload ID: 9083
  Gene Symbol: KLF10
  Gene Name: Kruppel-like factor 10
  Uniprot ID: Q13118
  ENST ID: ENST00000395884
  CDS Start-End: 904-2313
ggttcctaagggaacggcggctcgcggggagctggaaggggcgggcgcctcccggagcctggcgcccgcagccccgcccctccccgcgggcccggcgcgcacggccgggcggttggcggcggcgcccgcggcccctcccccgggtcgggcgcgggcgggggcccgcaagctcaggaagtaggggaaaggtgacggcgcggcaattcccagttcacgtttcctgcgcctcccggagcagccgctgatcacgctttgttcacatgcctcgccccctcctcgcccacgcccccgccccgggccgcacagccaatccgggctcgggccgccgagccggccggccaatggcgggggcaggggcgcggggacgtgcgagcggcgaggaatgttcccagtgactcacccgtgagcctcattgaggttagggcggccccatccgtcggtctccgccagctaggatctcccccgccgtccgcccccgcccctcgtctgcctcccccgcccgcgcctccgcccgcgcttccctttcctgcctcgcgccccactccctttcctcccctccctgtttcccttcctgtccttcccagctcacgctctctttccctgccgcctgcctttcttttttcctttttttgcattggcgtcttggggctgttacacacacgcgcgctgtccattgcagcttacataaaggcgggcgcgattatgcaattatattgttagcgatatttcaagagcaatggctcgttttcttaggatttcaacacgaaggcatcatgcatttttgaaaaactagtattgagaataataccttgcaacgtaaagaatgttttttggtatttttacacaatctctactttgaccaaacgagtctggacagttttcttttaatggaaaataggagaaatggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttgg

SEQ ID NO: 147042 - DNA, 4030 bp, Homo sapiens
  Payload ID: 9084
  Gene Symbol: KLF11
  Gene Name: Kruppel-like factor 11
  Uniprot ID: O14901
  ENST ID: ENST00000305883
  CDS Start-End: 163-1701
gagggccgcgccggggcagagccgcgcgggcgggcgaggcgcgtgccggccgcaggagctccgggttgccgccgccgccgccgcccgcagcccacgtgcggccgctgctgcgcccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 147043 - DNA, 614 bp, Homo sapiens
  Payload ID: 9084
  Gene Symbol: KLF11
  Gene Name: Kruppel-like factor 11
  ENST ID: ENST00000401510
  CDS Start-End: 233-614
acagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtag

SEQ ID NO: 147044 - DNA, 559 bp, Homo sapiens
  Payload ID: 9084
  Gene Symbol: KLF11
  Gene Name: Kruppel-like factor 11
  ENST ID: ENST00000448523
  CDS Start-End: 69-559
actcgcgcgcctgtaaatgcgggaggtggggcgtgcagggcttcgctgcggccgcgccggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactgggga

SEQ ID NO: 147045 - DNA, 653 bp, Homo sapiens
  Payload ID: 9084
  Gene Symbol: KLF11
  Gene Name: Kruppel-like factor 11
  ENST ID: ENST00000440320
  CDS Start-End: 287-653
acgcggccgtcgggcgggttaagagcggctagcggtagtgccgctcgggcctgggggcgggcaaggtctaggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctcc

SEQ ID NO: 147046 - DNA, 4033 bp, Homo sapiens
  Payload ID: 9084
  Gene Symbol: KLF11
  Gene Name: Kruppel-like factor 11
  Uniprot ID: O14901
  ENST ID: ENST00000535335
  CDS Start-End: 217-1704
ggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 147047 - DNA, 3885 bp, Homo sapiens
  Payload ID: 9084
  Gene Symbol: KLF11
  Gene Name: Kruppel-like factor 11
  Uniprot ID: O14901
  ENST ID: ENST00000540845
  CDS Start-End: 69-1556
actcgcgcgcctgtaaatgcgggaggtggggcgtgcagggcttcgctgcggccgcgccggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtatgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattg

SEQ ID NO: 147048 - DNA, 1407 bp, Homo sapiens
  Payload ID: 9085
  Gene Symbol: KLF12
  Gene Name: Kruppel-like factor 12
  ENST ID: ENST00000377666
  CDS Start-End: 274-1407
agccgctgagaggctctgcgtgtgcgtgtgcgcgggtgacgccgtgtgtgtgcgagtgtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtga

SEQ ID NO: 147049 - DNA, 10637 bp, Homo sapiens
  Payload ID: 9085
  Gene Symbol: KLF12
  Gene Name: Kruppel-like factor 12
  Uniprot ID: Q9Y4X4
  ENST ID: ENST00000377669
  CDS Start-End: 28-1236
aatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattacaaacacttgattttgggaattgcacatattaacctcacaatattactagctcatttttaaatgtctggacattctgaaataatttccggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcagatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccagggagactgcttttaggtataactacatgttgacaagattaagtgctgtggatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagacggaaatgtaccaggataagggggtaaaataaccaattaagtgtcaaaggaaagctgctgggttccttaatctcactgaagtcaagtcttctgactgggcttcttaccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaa

SEQ ID NO: 147050 - DNA, 6825 bp, Homo sapiens
  Payload ID: 9086
  Gene Symbol: KLF13
  Gene Name: Kruppel-like factor 13
  Uniprot ID: Q9Y2Y9
  ENST ID: ENST00000307145
  CDS Start-End: 359-1225
cggcagctgtcccgcctgccacaatgcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatctggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 147051 - DNA, 489 bp, Homo sapiens
  Payload ID: 9086
  Gene Symbol: KLF13
  Gene Name: Kruppel-like factor 13
  ENST ID: ENST00000560473
  CDS Start-End: 43-345
tctgcccacccatggattatcttgtaaagagtcacctgccccatggaggagccaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgtt

SEQ ID NO: 147052 - DNA, 574 bp, Homo sapiens
  Payload ID: 9086
  Gene Symbol: KLF13
  Gene Name: Kruppel-like factor 13
  ENST ID: ENST00000558844
  CDS Start-End: 533-574
cggccatgcagcctggtacccgaagagtcccccctctgcttggcacctgtaggacccccaaaccccagcatggcttagcccctctcccagctccccacagttcccccaaccctcctacagcctcccttcagggctccagggcacctagtgcccctccaggcttgaccccagcccccttcctctcaccaagtcttctcacaaggcctaaccccgccttgtcccacggcccccaccccatgcacaggcacaggcacacatagccagaacccctggggccctcccacctggggagctggagtgactctgagatccggcaggaaggctaggagctcctctgcaggagtctggaatctcctactggttctcttgtcattttggagctagagggagctcctgtcctggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgcc

SEQ ID NO: 147053 - DNA, 1051 bp, Homo sapiens
  Payload ID: 9086
  Gene Symbol: KLF13
  Gene Name: Kruppel-like factor 13
  ENST ID: ENST00000616962
  CDS Start-End: 47-907
ctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccccgagcccacctcccccggcgccgaaggcgcggcgggcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgtt

SEQ ID NO: 147054 - DNA, 1051 bp, Homo sapiens; identical to SEQ ID NO: 147053
  Payload ID: 9086
  Gene Symbol: KLF13
  Gene Name: Kruppel-like factor 13
  ENST ID: ENST00000618680
  CDS Start-End: 47-907

SEQ ID NO: 147055 - DNA, 6803 bp, Homo sapiens
  Payload ID: 9086
  Gene Symbol: KLF13
  Gene Name: Kruppel-like factor 13
  Uniprot ID: Q9Y2Y9
  ENST ID: ENST00000621843
  CDS Start-End: 334-1200
gcgcggcgaagctgcggccgcgacttggcgaggtggtccctaacgttgccgctcggcatccttagaaccggccgcccctgacgccgcgcggggaccccagtcgcccgcgcgccccatgcgctcactcttcggtgcccggccgggccggcgcctcgcagacgcggagccgcgcgggtgacggcacaggcggctgcgcgcccagcccagcccagcccagcccgaggagagggcgcgccgcgcccccgccccccgcccgctctcccgaggccgtgggtgcggatgcgcggctgacgactcgcagcaagagcaccgccgccggccccagcccgcagcatggcagccgccgcctatgtggaccacttcgccgccgagtgcctcgtgtccatgtcgagccgcgcggtcgtgcacgggccgcgggaggggccggagtcccggcccgagggcgcggccgtggccgccacccccacgctgccccgcgtcgaggagcgccgcgacggtaaggacagcgcctcgctcttcgtggtggcgcggatcctagcggacctcaaccagcaagcgccggcgcccgccccggcggagcgcagggagggcgccgcggcccggaaggcgaggaccccctgccgcctgccgccgcccgcccccgagcccacctcccccggcgccgaaggcgcggcggccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaacaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcagcgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctgactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaaactaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttt

SEQ ID NO: 147056 - DNA, 2827 bp, Homo sapiens
  Payload ID: 9087
  Gene Symbol: KLF14
  Gene Name: Kruppel-like factor 14
  ENST ID: ENST00000583337
  CDS Start-End: 29-1000
cgctcgccggcggccgggcggtcccagcatgtcggccgccgtggcgtgcctggactacttcgccgccgagtgcctggtgtccatgtccgcgggcgccgtggttcaccgccgcccgccggaccccgagggcgcgggtggagccgctggctcggaggtgggtgcggcgccgccggagtccgctctgccgggtccggggccaccggggcccgcgtcggtcccccagctcccgcaggtccccgcccccagccccggcgcgggcggcgccgcgccccacctgctggctgcaagcgtctgggcggacttgcgcggcagctctggcgagggctcctgggagaactcgggggaagctccacgcgcctcgtccggcttctccgacccgatcccgtgctccgtccagaccccgtgctccgagctggctcccgcctccggcgccgcggcggtctgcgctcccgagagctcctccgatgcgcccgccgtcccaagcgcgcctgctgccccgggcgcaccagcagcctctggtgggttctctggaggggccctaggggcaggccccgcccccgccgcggatcaggcgccccggaggaggtctgtcacacctgctgccaagcgccaccaatgccccttcccgggctgcaccaaagcctattacaagtcgtcgcacctcaagtcccaccagcgcacccacacgggtgagcgccctttctcctgcgactggctcgactgcgacaagaagtttacgcgttccgacgagctggcccgccactacaggacgcacacgggcgagaagcgcttctcctgccccctctgccccaagcagttctcccggagcgaccacctgaccaagcatgctcgccgccacccaacctatcatccagatatgatcgagtaccggggacgtcgtcgaactccccgcatcgacccgccactcaccagcgaggtggaaagctccgcctccggctccggtcccggcccggcgcccagcttcaccacctgcctgtaggacagtcattgctgtcagtcttaccctcaaggatgatcccccaggccgttgtccctgctttctctctgcccatccttctttcccagagtcattacaccaaggcacagactggttcctctgctctgagggtgggtccaggcagacatgtggactctggggaggtactgggggccggaaaatagcgggaattcttgcaacgtgtatatcatcctaaaagtgggggttgcctcaagacagcccccaggaactgataagaagggatgaactcccgtactctccagagtactgaagattctcccctccctggaaccagggatgtgaaactggaattctcagatgcctgaggagctcccagtctcaaaggactctggtgtctcacccatccaccagggcggaccttggagagggtgtcaggggtggcagtcttggaaatgtccaggactgggatggtgagaggcctttggaaacagaaatgatttctatttctgtaaacagcaatgtttactaatttatttttagcatcttttaaatagggatcccaggttgatgggaggcttatgccctccaatcccccaattgccccagctacctctgctaggagaggccacataagctccatgtagatgtgtggctgggagatacttcttgatgtctggggtgtgagtctgtttgcaggtcctgttgcatgatttggaaccctgcgcttgcgtcgtagcccttctccccatttggattcctacttgaggatggtaacttcctggctcactctcacgctgagattggttaaacaatttgaaaactaccgtaaaggcaccagcaagaaaagggtggtccagactagttcccccttcactcagagagaaaactcaagcgaccttaagtttgggcggggcccgaaacaagaccgctcataaccattgataactttcagggaaatagaggcgtgtggacacagctgccccaccttatgtaatctcaggagtggtagattctgttaatttcctaatggctaactagggggttatttccctcagagtctgcagattttcgtttctgaaacaggtgagttggtgggtgggagagggaagggtaacagactggtttcttccaaggagctggctgccttggatttgaggaaggagtagcaaggtgatagctattatgaaataggaggaactttctcctctgaccatatagtccctccaagttatatcctcagggcccctttcccgataagaaggaatcagacatcaacagtatttgttttttctatatgtgtctctgctgctgtggatgaaatcactgaccactctgcttgtgtatgtatgaatgtgtatatatgtgaccctttctttagagatgaggctgaaaggcatttcctgccctgggagatcccctctggccccctcctgaatattttgcaatagtccatcactgacacttggggaagatgctgtaatctcataggaccctaacgggcatctggttaaacaaattgctttcccctattttgcagatgaggatactgaagactagataagctcaaagtcatatgctaggttgctgggaagagccatgactagaacttaggtgtctggcctgctaagtgactctttccctcacacttgattacccccatctcttcctcctctctgggatcttagtccctccctcgctccctattctgtattgcttctgtgtaccttcacatgttgattgaaccctttgcctattgtgtttgacccaaaagcccttttcttaactggttacgttccctcccttcacaccatgtggacataaagtgagaatgactttttggcatcctag

SEQ ID NO: 147057 - DNA, 2574 bp, Homo sapiens
  Payload ID: 9088
  Gene Symbol: KLF15
  Gene Name: Kruppel-like factor 15
  Uniprot ID: Q9UIH9
  ENST ID: ENST00000296233
  CDS Start-End: 232-1482
ggggagtgagtgcccagcgagctgcgggcgggctagtgctccgccgcagcgacccgcgggccggcgggcgatcgagccagcgcaggacccgcggctcggcccccggccgccgccggaccgagagtctagccgccgcccccagcccagcccgcccggccgcaggaccgccggggcctggccgccggtccggcgtgcgccaagttcagccgccaccggcacggccaggccagcatggtggaccacttacttccagtggacgagaacttctcgtcgccaaaatgcccagttgggtatctgggtgataggctggttggccggcgggcatatcacatgctgccctcacccgtctctgaagatgacagcgatgcctccagcccctgctcctgttccagtcccgactctcaagccctctgctcctgctatggtggaggcctgggcaccgagagccaggacagcatcttggacttcctattgtcccaggccacgctgggcagtggcgggggcagcggcagtagcattggggccagcagtggccccgtggcctgggggccctggcgaagggcagcggcccctgtgaagggggagcatttctgcttgcccgagtttcctttgggtgatcctgatgacgtcccacggcccttccagcctaccctggaggagattgaagagtttctggaggagaacatggagcctggagtcaaggaggtccctgagggcaacagcaaggacttggatgcctgcagccagctctcagctgggccacacaagagccacctccatcctgggtccagcgggagagagcgctgttcccctccaccaggtggtgccagtgcaggaggtgcccagggcccaggtgggggccccacgcctgatggccccatcccagtgttgctgcagatccagcccgtgcctgtgaagcaggaatcgggcacagggcctgcctcccctgggcaagccccagagaatgtcaaggttgcccagctcctggtcaacatccaggggcagaccttcgcactcgtgccccaggtggtaccctcctccaacttgaacctgccctccaagtttgtgcgcattgcccctgtgcccattgccgccaagcctgttggatcgggacccctggggcctggccctgccggtctcctcatgggccagaagttccccaagaacccagccgcagaactcatcaaaatgcacaaatgtactttccctggctgcagcaagatgtacaccaaaagcagccacctcaaggcccacctgcgccggcacacgggtgagaagcccttcgcctgcacctggccaggctgcggctggaggttctcgcgctctgacgagctgtcgcggcacaggcgctcgcactcaggtgtgaagccgtaccagtgtcctgtgtgcgagaagaagttcgcgcggagcgaccacctctccaagcacatcaaggtgcaccgcttcccgcggagcagccgctccgtgcgctccgtgaactgaaagcgccctgaaccccagcctgtccgtcaccccggatccccaccccatccccatttttttaagcaataatttatttgcctcctccagagggacatggcaatgttaccagcccaccttctgaagcctgggaggtgtgaacccagggcccgccaaccgctgcctttctcgggagtacttagagcctcgaacccgcgtccctgggggctgggccccaggcgcacggggctggaggcaggccttcgtgccttcgtgccttcgtgccttcccgcggtggccaggcctctgctgcagccgctggttgcaggcagagttttggggacctggcccttctcccactgggctcccccatcctgggccaaggccagaactttagtgctaggggaagatgaaatgtgcagttttgaaatgttgggtttccagagagagtcatgctggaggagaaggaagtaggccagaagtccagggctgcactgtggtgtgagggtggctttgtctaagatgcctgctcagcatgatcaccagagggtgtgggcaggtccctggagccgggggggggggggggggggggggggggcaggaccgggccgctgggccctcatgtgggagagaggtgaaaagcgtcccccactagggggctggcagtgcatgtgcttgagttaaatgtgcagggcagacagagccagaagggcctgtacccaggggctcgtcccctcctccggtttcccagacaaatccagacaccagcctttagggtggccttgggaggagagggccaggctgtcctgggtgtgagagaactagatagagcctcccaaccctgatttagaaatgcattccttattttgtctagaaattaataaatgaactagcttgttttgacaggtttatttcacatcctatgaatgtatgtaaataaactgtacataggtccatccacataaaatatcttttaataacatatcaacatttgtgtaaatttgaaatttaaaaaaatctatgaagctggtgtacatatgttacaattacgtatattttctttggtccttcataaaaatatatttactttgccaataaaaagaaaaagaactcaca

SEQ ID NO: 147058 - DNA, 2890 bp, Homo sapiens
  Payload ID: 9089
  Gene Symbol: KLF16
  Gene Name: Kruppel-like factor 16
  Uniprot ID: Q9BXK1
  ENST ID: ENST00000250916
  CDS Start-End: 72-830
cgccgccggccggacggacgccgctcccgccgcctccgctccgcccgccgcgccgcgcgcccttgctcggcatgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagaggtggctctcaggatgggtgacgggggcttgtgtctgtaaatagccatgatactaactttcttcccatctgtgcaacggggcccccccagggcagctaggaggtcctcccctctcctctccaccaccccctgctgcccccctcccggggtggggtttgggggggtggagtggacttctgggagccggcccggggaaagcaccccctgccccatccctgcagattgggatgaagtgttcagacagccatagaggagtcgggggttgacacggcccctgcctctccccaccccacccccaccccaccgaaagccatgggagtagttcagggaaatgggggtgcagcccagccaccccccattcgggtactcaatctcaggtgtccacaagttctgcccacggtaggggctgcctggccccccagacctcgggggtagagccaggagtggggcagcgttaggatgcccggaggggctccaggtgttgcttctgagacctgggatggggagggaggggacctctgggttcttccaaagaacatttgactcagtggggtcgggagggaatcctggcttatttattttcctctgtcctcgggtgtgggggccctagctcgccctctctgggtgggtgggtgagagaggctgcaggggaggctggcaccgggcttgggcctccagtccctgccttgctgactttggccgttgcggtatcacgtgacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 147059 - DNA, 1134 bp, Homo sapiens
  Payload ID: 9089
  Gene Symbol: KLF16
  Gene Name: Kruppel-like factor 16
  Uniprot ID: Q9BXK1
  ENST ID: ENST00000541015
  CDS Start-End: 1-759
atgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaacccta

SEQ ID NO: 147060 - DNA, 508 bp, Homo sapiens
  Payload ID: 9089
  Gene Symbol: KLF16
  Gene Name: Kruppel-like factor 16
  ENST ID: ENST00000592313
  CDS Start-End: 20-367
gcggtcgggcggcgagcggatggccgccccggcggcagtggcgggggctccgggggcccagcgaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggaggg

SEQ ID NO: 147061 - DNA, 1133 bp, Homo sapiens
  Payload ID: 9089
  Gene Symbol: KLF16
  Gene Name: Kruppel-like factor 16
  Uniprot ID: Q9BXK1
  ENST ID: ENST00000617223
  CDS Start-End: 1-759
atgtcggcggccgtggcgtgcgtggattacttcgccgccgacgtgctcatggccatctcttcgggcgccgtggtgcaccgcgggcggcccggccccgagggcgcgggccccgccgccggcctggatgtgcgcgcggcgcgccgcgaggccgcctcacccgggaccccggggccacccccgccgccccccgccgcttctggcccgggccccggcgccgccgcggcgccccacctgctggccgccagcatcctggccgacctgcgcggcggacccggagccgccccggggggcgcctcgcccgcctcctcctcctcagccgcctcgtccccgtcctcgggccgcgcccccggcgccgcgccctccgccgccgccaagagccaccgctgtcccttcccggactgcgccaaagcctactacaagtcctcgcacctaaagtcgcacctgcggacgcacacaggggaacgcccttttgcttgtgactggcagggctgcgacaagaagttcgcccgctccgacgagctggcccgccaccaccggacgcacacgggcgagaagcgcttctcctgccctctgtgctccaagcgcttcacccgcagtgaccacctggccaagcacgcccgccgccaccccggcttccacccggacctgctccggcgccctggtgcccgcagtacctcccccagcgactcgctgccctgcagcctggccgggagccctgcgcccagccccgcgcccagcccagcccccgcaggcctgtagggccctcgtgcagcccaccctgaccgccaggatgcttctgccatccaggggtgtagtgaggacccacggggagcctgggccccttccagccgtgggcaaaccctgaagacacccctgcccccctccagagagtgaggagggggcctgagactggacctgggtctgcctgacctcagagtgtccaggggcttggagagacctgcgcccacccctccactctcccaggagtcgctgatcactgggacctggttccagccgtttgcaggggaggcggctccgagaggcgtgtgctttccgtgggtggcgcccctcccccgccctgcctggcctcatccttgtatttaattaattaaacaagcccctttttaaaccct

SEQ ID NO: 147062 - DNA, 3131 bp, Homo sapiens
  Payload ID: 9090
  Gene Symbol: KLF17
  Gene Name: Kruppel-like factor 17
  Uniprot ID: Q5JT82
  ENST ID: ENST00000372299
  CDS Start-End: 59-1228
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaagcattcagcactttcctcacagcgcagagatgctggggtcccctttggtgtctgttgaggcgccggggcagaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccaatgggctgccagtctcggcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatggagagcaggacagtcctcctgctgctggtccttaggtgaatgaagaaggaagaggattccaggctgagagcactggacgtggcaactgttcagaggagaggcagtcttcaagttctacattcattcagaaaaatgttttttgagcctacaatactgagcgcaacaaggctgtggagacccatggtgaggagcatggagttaactaaaggatgtgtcagggaagaaagacttctcaaggaggtgcctccatcagacccaaaggactcatgggggctagctgcacctcacatttcttggacatataccgttggacatgtctatcttctggaaactatggcatggacagtaaggattcagaagtgcatgaaggcaccctgcctctgcagagcagaaagatcatagacaacatttatgaatgtgcccagtgctgccaagaagagaagccggtcctctgcaggctcaagcctatctgggcctctggggaagccccacagccttggctgtgcctgcccctgccctctcacccctaccctgaccttgtcctacttcactgcctttgtctgtgttactagtggccccagtatacctgggatggacatccaggtgcccttcatccaagctcctatgtgaggggaatggacattattaaaagaacaggggcagaagtggctcatttatgacccattcactagccccagggattgaagtcttgggtactcaaagtgtctttctaccagggcaccagatcccttccatggagcaggtcatctcgggttcactgggccagggatggtctctgttccccagcccacctggctcacacacagcctcatgggtagggtcagcaaaccagatggcttgttgttggaatgtaggatgagaggcctgcttggtgacctagcattttcaccaagaagtggacgtggagaggaccagagtgatcaagggtgtatgatgtgcactacaatggtgggcaaaacaggctcctgctcttgtggaggtcacaatctagcggagaaaggatgttactagaagtacacaaattgggcccggcgcgatggctcacgcctgtaatcccagcacttttggaggccgaggcaggcggatcatttgaggttagagattcgagaccagccgggccaacatggtgaaaccccatctctacaaaaaatacaaaaattagcctggcatatggcgggtaccgtaatcctagctactcgggagactgacgggagaatcgcttgaacccaggaggcggaggttgcagtgagctcagatctcaccattgcactccagcctgggcgactgagcgagactctatctcaaaacaatcaaaacaaaaaagacctgtggactctagtagattttgaatcctgcctctgccatttcctggctatgaggtgtcttgagaaatttacttgtcactcttgcttctgatagtaaaggggatggtgcgatagattcaagatggagagataaggttaagtgttttctttggctgcaacatggagattagattagagcaaggatgtaagggagaggaagggacatagcagtatttcaggtgagagtcaaggtggctttggctagggtgtgagagtggaggtagggagaagtaggaaagtgatagttaactggatttgttaggtgagggtgaggccaagggtgacttccaggttcctgacttgtgttataagtaacacagaagaagaatggatgaacttgattcgttttccattgattgtgatatctatcatacctgcaaaaaatattttgtatatatccaatttaataataaatgcactcatgttaggaaggtcaaaaaaaaggaaaaaagaaaaataataaaaaataataaaaatccttaggataacttgaggccaggagtttgagaccagtgtgaccttgtctctgtaaaaaataaaattaaaagaaaaa

SEQ ID NO: 147063 - DNA, 695 bp, Homo sapiens
  Payload ID: 9090
  Gene Symbol: KLF17
  Gene Name: Kruppel-like factor 17
  ENST ID: ENST00000476802
  CDS Start-End: 39-386
gtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaagcattcagcactttcctcacagcgcagagatgctggggtcccctttggtgtctgttgaggcgccggggcagaatgtgaatgaaggggggccacagttcagtatgccactgcctgagcgtgcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaa

SEQ ID NO: 147064 - DNA, 3159 bp, Homo sapiens
  Payload ID: 9091
  Gene Symbol: KLF18
  Gene Name: Kruppel-like factor 18
  ENST ID: ENST00000634670
  CDS Start-End: 1-3159
atggattccagtcttctccaggcaattgaggaaattgagaaatttttccagcatctctctgagcggcatacagaacaggcagaaaccccagatgcaccagaaccacagaactgtatgcctctgactgcccatgctgaggagagccaacatgagtcaacccagagcaagacgatgcctcccttggggtccacaatgatgacttctgcatgcactaacatccctgggacagttctcacccaggacttaacaatgcaccctcttaaagcccttgaagacctaagtgagacttattccatgggccagaaagtgacttcctttgatcaggtaaaacacacagcaggctcccagatgacagatgttactgtcaccccaaagtcatcacccactgattgccagaagacaaccatcactgcaagcaacatgacaatctccaatgaaagtagccagctgaacaccccaagcagtgaccagaccctcaatgagagtcagataccagccctgcttggagatcagatgaagaccctcagtgataaccagactctctgtggggaccaggtgaccttcagtagtgaccagaccctcactgatggtcatacagtgacttccggtagcgatgagaccctctctgggggccaaatgacaaccagtctagacctctatggagggcaaatgatgacttccattgataaccagaccctctgtggggagcagatgacgacctccagtggtaaccaggccttctacgggagacagatgacgacctccactggtaaccagaccctctgtggagagcagatgacaacctccactggtaaccaggccctctatggggggcagatgacgacctccgctagtaaccagaccctctgtggagagcagatgacaacctccactagtaaccagaccctctgtggggagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctgtggagagcaagtgatgacctccactagtaaccagaccctctgtggagagcagacgacgacctccactagtaaccagaccctctgtggggagcaggtgacgacctccactggtaaccaggccctctacggggggcagatgatgacctccactggtaaccagaccctctactgggggcagatgatgacctccactggtaaccagaacctctgtggagagcagatgacaacctccactggtaaccaggccctctacggggggcagatgacaacctctactagtaaccagaccctctgtggagagcagatgacgacccccactagtaaccagaccctctgtggggagcaggtgacgacctccactggtaaccaggccctctacggggggcagatcacgacctccactagtaaccagaccctctgtggagagcagatgacgacctccactagtaaccagaccctttgtggggagcaggtgacgacctccactggtaaccaggccctctatggggggcagatgatgacctccactggtaaccaggccctctacggggggcagatgacaacctctgctagtaaccagaccctctgtggagagcagatgacaacctccactagtaaccagaccctctgtgaggagcaggtgatgacctccactggtaaccaggccctctgtggagagcagatgacaacctccactggtaaccaggccctctacggggggcagatgacgacctccactagtaaccagaccctctgtggagagcagacgacgacctccactagtaaccagaccctctgtggggagcaggtgacgacctccactggtaaccaggccctctatggggggcagatgatgacctccactggtaaccagaccctctactgggggcagatgatgacctccactggtaaccagaacctctgtggagagcagatgacaacctccactggtaaccaggccctctacggggggcagatgacgacctctactagtaaccagaccctctgtggagagcagatgacgacccccactagtaaccagaccctctgtggggagcaggtgacgacctccactggtaaccaggccctctacagggggcagatcacgacctccactagtaaccagaccctctgtggagagcagatgacgacctccactagtaaccagaccctctgtggggagcaggtgacgacctccactggtaaccaggccctctatggggggcagatgatgacctccactggtaaccagaacctctacggggggcagaatatgacctccactgataaccaggccctctatggaggccagatggcaacatatagtggcaaccagaccctctatggggaccagatgctgactcttcaggtgggcaatatgacaacgctcactgatgaccacagcctttatgggggatatatgatgtcccatcagttctcatcattgccatacccaggattcctatgcttttcaagttcccatttgattcaaggacaactcccaaaacagaagacacagagctgccagttctggaagaatcctgaggtttcaaggccctatgtctgcacttacgaggactgcaagatgtcttattcaaaggcttgccacctccgaacccacatgcgcaagcacaccggggagaagccctatgtatgcgatgtagagggatgtacgtggaaatttgcccgctcagatgagctcaacagacacaagaaaaggcacactggggaaaggccctacctgtgttcaatatgcagcaagaattttgcaagatctgatcacctaaagcagcatgcaaaggtccacaacattcgcccaggattatga

SEQ ID NO: 147065 - DNA, 2018 bp, Homo sapiens
  Payload ID: 9092
  Gene Symbol: KLF2
  Gene Name: Kruppel-like factor 2
  Uniprot ID: Q9Y5W3
  ENST ID: ENST00000248071
  CDS Start-End: 108-1175
ccgcggcccacagagccgtccccgcccgcccgcgccccgaccagcccggcctcgggcagccactcaccggtgtccccgtccgcgtcctttctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaatcacagcactggtctggttgcttggaactggggccttggggcacttgggaggaggggggagcggagagtttgatggagggcagccccactaaagcatcgtgtgcagtgggtcctgcgtctgccagcaccgggactgccagctgctgtgcctgcctgccaggaacctgtgggtttttctgtaaatttagacactgcattttaggactgagggagggttattttaaggttgttctttgagccataaattgcctctttgccccacagctggggaaagtgctggtcccactgacgtggcctcctctacgttgaaaaaaataaaactacttacctcttcctggaa

SEQ ID NO: 147066 - DNA, 564 bp, Homo sapiens
  Payload ID: 9092
  Gene Symbol: KLF2
  Gene Name: Kruppel-like factor 2
  ENST ID: ENST00000592003
  CDS Start-End: 85-321
gcccgcccgcgccccgaccagcccggcctcgggcagccactcaccggtgtccccgtccgcgtcctttctccccgggtcccggccatggcgctgagtgaacccatcctgccgtccttctccactttcgccagcccgtgccgcgagcgcggcctgcaggaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttg

SEQ ID NO: 147067 - DNA, 5122 bp, Homo sapiens
  Payload ID: 9093
  Gene Symbol: KLF3
  Gene Name: Kruppel-like factor 3 (basic)
  Uniprot ID: P57682
  ENST ID: ENST00000261438
  CDS Start-End: 306-1343
cgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaa

SEQ ID NO: 147068 - DNA, 1871 bp, Homo sapiens
  Payload ID: 9093
  Gene Symbol: KLF3
  Gene Name: Kruppel-like factor 3 (basic)
  Uniprot ID: P57682
  ENST ID: ENST00000514033
  CDS Start-End: 305-1003
gcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagaatgctcatgtttgacccagttcctgtcaagcaagaggccatggaccctgtctcagtgtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagtaagtatatttaggtctacccagcatttgcatagtagtgtgcatcttggaacctggagcagaagcacaagatttcacacgtgtgatgtggtgtggatgaccaggaacggcttgtgatctgtggccgccactggtccagtaccactggtcaagatgggagaatctctccaaaaacaatatgctgttacactgacaacgttatgacaaaagttacatcaagttttcatggaatcagtcatccatgattttgcaccttaccacatgaattatttttgttttttttccattcttccaggctatgtatacttagtttttccattatgagaatccttgtatagattaaacttggtgttctgtggatcatgtaaagttttcatgtggacacacatagtccttacagagtgtatagtatcctgtagaattgctatccagtaggaaggctgtgcagtgttggtcagcatccaagcacctgaatggtggtttcttgtaggtctaacatggtataatgtggtagttgccacacacagcttcagtaacctcatttgtgggatcctgctgtagataaccttgacctccaccagtgattacactgaaggctgggtttgtagttgctaagaagatggttttcgggtccaacaaggatcccacctctgctctctgccatatgtatgatcttggactagtcacttaatcttgctgccccatttctgttttcattattgattgtagttgtgattgtcttgtgttatggtgcttcagcattggattcagcagccagcttcctagtacgaaggcaacgattacctccacagggtcccttccattgtcctcctgcatcattttcctccaacttgaataaatgttctacccac

SEQ ID NO: 147069 - DNA, 2813 bp, Homo sapiens
  Payload ID: 9094
  Gene Symbol: KLF4
  Gene Name: Kruppel-like factor 4 (gut)
  Uniprot ID: O43474
  ENST ID: ENST00000374672
  CDS Start-End: 475-1914
ctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaa

SEQ ID NO: 147070 - DNA, 800 bp, Homo sapiens
  Payload ID: 9094
  Gene Symbol: KLF4
  Gene Name: Kruppel-like factor 4 (gut)
  ENST ID: ENST00000411706
  CDS Start-End: 103-800
gaggaccggtgggacgcgccggaacgacggccgaaagccgcccctgactctcctgtctccgctccctgccttgctcgcaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagta

SEQ ID NO: 147071 - DNA, 822 bp, Homo sapiens
  Payload ID: 9094
  Gene Symbol: KLF4
  Gene Name: Kruppel-like factor 4 (gut)
  ENST ID: ENST00000420475
  CDS Start-End: 756-822
actcctctggccttctcttgaggctcccagttcacgctgcacagtgctgggcactgcctcctctccacacccctagcgccccccacccctcagcagaagggcccgcgaggaaccgtgcgaggtcaggccgagcgccggcaccgccaccggcactggcgctgagcgacgagagcggactcctgcgagcgcagagagggagggggagatggagggctggatgagtcacgcggataatcgcgctcttctccagcgcgcagacagcgcggcaagcgcgtatgctagcaggggtgcggacgcgtgaccgtgccgcccgctgaccccaccagtcttcgcgggcttcgaacccagggagccgacaatggcgttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgt

SEQ ID NO: 147072 - DNA, 1956 bp, Homo sapiens
  Payload ID: 9094
  Gene Symbol: KLF4
  Gene Name: Kruppel-like factor 4 (gut)
  ENST ID: ENST00000610832
  CDS Start-End: 622-1059
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataacctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctg

SEQ ID NO: 147073 - DNA, 3566 bp, Homo sapiens
  Payload ID: 9095
  Gene Symbol: KLF5
  Gene Name: Kruppel-like factor 5 (intestinal)
  Uniprot ID: Q13887
  ENST ID: ENST00000377687
  CDS Start-End: 537-1910
gcggccgccctgcgcgcgaagctcgtggcccgagaggggtgcggtcgggccgacggaggcggggccctggctgcctctctccctgctcataggctggccgctcaggcctggccggcctcggggcctcgggattcgcggcggcgctgccaatcaggcgatcgggccccgcccccccggagttgggtgaaatagaggcgggcgtcaagtgtcagtagtcgcggggcaggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagatgta

SEQ ID NO: 147074 - DNA, 2951 bp, Homo sapiens
  Payload ID: 9095
  Gene Symbol: KLF5
  Gene Name: Kruppel-like factor 5 (intestinal)
  Uniprot ID: Q13887
  ENST ID: ENST00000539231
  CDS Start-End: 196-1296
actttagctcagacctttcttttaaccttgcctatcatgtttcgagtcagaatttaaatactgtgcagtttaagctacaatacgcttggcctataacttggttccaggcatttatatttatgtcacttttgtctacttattatactaacaaggtggaaaaagcaatcccagtctctccaaaagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaacaaaagcaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatgacaggcagccacgtctcaacatgggtaaggggtgggggtggaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttagggtgtcgttttcacatatgacaatgttgcatttatgatgcagtttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagatgt

SEQ ID NO: 147075 - DNA, 2169 bp, Homo sapiens
  Payload ID: 9096
  Gene Symbol: KLF6
  Gene Name: Kruppel-like factor 6
  Uniprot ID: Q99612
  ENST ID: ENST00000469435
  CDS Start-End: 180-1025
ttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtcagtgcccacgcgggccccggagggcggccgctggtgggcgccactgcattgcaccagccctggagggagccgggcctggctgcacaggatgtggtcagggcagacaaatcctcacttcctcagatgttttccaccaaagcattaggtctttttggagttcagagtagaatcctaaagactggacttttgagttggataaatgtgtaacaattttcagattaaacaaacaagagactagatccttttctccacggacacccaaacctccaccccccaccccttagtagtgctggggatccgaggccactgccccttcaccagtgcactcgcacgaggctacctcgagcggccctggggtttcctaaatgaaactcaagggtcaggacagagggttgctgggcagcgtggagtgtgtgggtttgatgctgacggcccgaggcccgagtgggaccggcctgctctgtaagcagcagcattgatcagcgagtgtttcctgagaacttctccgtgtctcatgcagcctttgtttctgataccgcttgaaacagtttcttaatgaaatgccatacctaggtgaaagtgctatttaaaaataccttgacatgttctaggataattggtgaggaatcacagaacatttagaactgggaagggtcttagtgatcacgtgatgcaggctcttctcttatcagtaggagagcaaattgctgagagtcagtcccagacaggcttggtgacagctgagattgagatccgggtggcccaatatccaggcccaggcctgtctcaacataccctgagattggcttgacaactttgttttctcaggtagcacttgtagtaaattcatatttatgatttgaccaaggaatgaagtgaacccagttgttcaattgccatttagagaatgattccggggccctgtactggggctttccagaagctcgtaacttcagctttgtagaaaggtagaacgtccctgaggaaactgcagaggcacattccatagggaagtgaggatggaacagaagtgtgtttgggagaaacagttgccatgaagaaagcaatagctctgcctttgccggggctgtgggtccggcaggctgacacctcatcccgcaagcattttgctggtctgagtcgtggtcgttcttccacgttaactttgatgacagcaccatgggcttggctgaagctgtgtcccttggacagcagtgggaggcctgagactgggtcaggagagagctgctgttgtctctctgaggctgccagttgttgtgtgttaccgatgccagaagccactgggtccct

SEQ ID NO: 147076 - DNA, 4656 bp, Homo sapiens
  Payload ID: 9096
  Gene Symbol: KLF6
  Gene Name: Kruppel-like factor 6
  Uniprot ID: Q99612
  ENST ID: ENST00000497571
  CDS Start-End: 262-1113
ggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggagaaaagccttacagatgctcatgggaagggtgtgagtggcgttttgcaagaagtgatgagttaaccaggcacttccgaaagcacaccggggccaagccttttaaatgctcccactgtgacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgcca

SEQ ID NO: 147077 - DNA, 4537 bp, Homo sapiens
  Payload ID: 9096
  Gene Symbol: KLF6
  Gene Name: Kruppel-like factor 6
  Uniprot ID: Q99612
  ENST ID: ENST00000542957
  CDS Start-End: 268-981
gagccaggcgggggcggagggggaggctggcagcggagctttgaatagggaagttttgcaggggttacgtttgcagtcagtccggtgtttgcaaatattgtgtgggctccgcgcgctgcgggctgcgggagggtccggccgggcgtctctgcgagcctggagtttgcatgaaactttcacctgcgctccggggagactttcggctccggctcccaccgcgcgcctcgccgccctcgcgaccgcgggctccgtccaacccggcccgacatggacgtgctccccatgtgcagcatcttccaggagctccagatcgtgcacgagaccggctacttctcggcgctgccgtctctggaggagtactggcaacagacctgcctagagctggaacgttacctccagagcgagccctgctatgtttcagcctcagaaatcaaatttgacagccaggaagatctgtggaccaaaatcattctggctcgggagaaaaaggaggaatccgaactgaagatatcttccagtcctccagaggacactctcatcagcccgagcttttgttacaacttagagaccaacagcctgaactcagatgtcagcagcgaatcctctgacagctccgaggaactttctcccacggccaagtttacctccgaccccattggcgaagttttggtcagctcgggaaaattgagctcctctgtcacctccacgcctccatcttctccggaactgagcagggaaccttctcaactgtggggttgcgtgcccggggagctgccctcgccagggaaggtgcgcagcgggacttcggggaagccaggtgacaagggaaatggcgatgcctcccccgacggcaggaggagggtgcaccggtgccactttaacggctgcaggaaagtttacaccaaaagctcccacttgaaagcacaccagcggacgcacacaggtgtttttccaggtctgaccacctggccctgcacatgaagaggcacctctgagggagcagagaggtggatcctgtaggctaaaaggcttccaggctgagagccggccgtggaaggagggatgcgtgttccagccaaagcatgccgttctgcaccctacccagttgcctccagggcctctccttggaaggtcttttgagggctaaaaaggtcctgtaagaagcggcatagcacccgtggtgcatggtatgtgggtgaccctggactcgccactggtacccgcccttccgagcggcgcctaagcctttgccgtgagcatgcacactgagaatgctaatggttgggttgattgtatgttgaggatctattactgaccgtatgatgaggccaactttttttccttgtggttagcaagactgcaagagatggaaaaaaagtagtttgaatgttttgtgtgtaaggagtataccatgagatgagatgaccaccaatcatttccttggggggagggggtgtctgcaccttagaaaaaaaaagaaaaatcaaaaaaacaaaaaaacaaaaacaaaaaaagaaggaaaatcttggagggtgggcgtgggaactcaggaccccagagtggcgagtggtgtggggagggagagcctctctcccccttttctgtgtgagaggaactcttagtgtctggtgcagctattaaatgtgcaatgtgtcaagtagcttgttttacacgctacaacatagctcatttgtaacccattgtataagctgtgtatttacaaatataacacaacaatttaacttttccttagaatacaaaaagtcatgcatggtctggggaactatatgcttttccatttttaagtcaggactgcaatactgattccagttaatgagcagctaagatccaatctgtctaatacagtgaccccctagccatccgggcctggcaatatacaattttttttcccctccaagtttgtaacactccccttccagaaaggcattgtgcaacacaggattatttttaaatgattctgaatttgaattaactttttggagaattctgtgatgcccttagaagaaattggacacgtattgagtgtcacaaagctggggctgggaattgctggtctaatgtttcattagacttaagaacctaaaatttttctcagttgggtggataaaaccactaacgcttagaaactgttttctcatgcagctatgtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaggaaaaaaaaaaacttgcactggcttgtctcacttacgaaacatgtcggagctgtttgcctgggtggggctgggtaccgtacctgtcaatgcctgtgattttcataattagcacgtacataaagaagtacattctgttcaggtgataactgagcctcaatcaagcagaaactttttgcttgaaattaaaaaaaaatttctattagtgaaatttcttttttttttttttttggaagcaccctgttatctaaagaatctttgtaagatttttgtaaaattttgttttacaagattttatttgaaattgttttttgcaagattgttatatttctgtatgaatgtattttttattggaataacataaaagaattcttatcagcatcttgagtctggttgttttttttgggggaagggggttgttggaacagattcctcctgcattcatcaccctggcttcctcctgggggcaaatcttcattgagcaaccctgagaacaactcaccgacctcagccccttcctctttccacagcctgtcctgggagctggagaggatgtcagcgagcctgacattgccctccctgaatgcatcaaatactcttctccaaggactgacaaaaacaaccccccggctgtgggcacagtagggaaccatgccggtttgatcttccattgctcaagccagggaatgcattgcagaggcacctgcacaacgacaaacttgagtgtttccctgccacttctgtgcctccacagcctgctccagttccgcagctagagctgggcctaccttccccagccagccctgccacacacctggctgaggcatgtctgggaggggtggaggaggcagagggactccaggccagagggctgttctcacaacctcagcccactctcagtcaaggagggcagaaaataaaagatgacatcactgcc

SEQ ID NO: 147078 - DNA, 8362 bp, Homo sapiens
  Payload ID: 9097
  Gene Symbol: KLF7
  Gene Name: Kruppel-like factor 7 (ubiquitous)
  Uniprot ID: O75840
  ENST ID: ENST00000309446
  CDS Start-End: 378-1286
agcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttccttttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaacaaaataatacaaaacgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctattttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagccgagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaacccggcctggtgtttctggtggtgtcctaacaagcacgcttttatccagggttcagatttgttcatgtagaaaaagagtttctaagccactgacaattttttttttttgtaatttcaaattatacttctttctcctgccacatgactgtaagtcatagacatggaaacctgaaattataatgctgctcctagctactggcctcctgccccacccatggttaatggctcagctcaatgcctggtggtaatgagtattatgtccagaaaaagagatgttcagattccatgacaaagctgcatttttgtaaaaatattggagaccccaaaatgaacttcatgctgaccatttcctcctctctgtgtgctttcccttgcaaagcccttcaaatatcctcttctctcgacgccatctcctctccacctgcacctcttgtgccctttgtacatctttgattgcctgatgataacagggtaaaaggacagccaacctcatgcctgattagcagaactgaatcctagttttaaaaaatcttctctggcttcagagaagattttataaggacttttgtttgggataagctttccagattatccatgtctatttgcatcaaaggggaaagaaatggggcttttggatggctcttccagtgcattcggaacattgcctcttgcctttattcctgcattttatggcaaagccaaaagaaactcaagttgcaagaacaaaacccagtgactcgttttgatggttcaaaatggtttcctttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatcccagaaaagggaaaaataaagctgcagttaactttcttatgtgcatccttccaatagagtactgtatttttcaggtgttttgcatttaacataaaagtcctcgggaaacaggtgtcaaaaacagagagagaaatcctgggccatcacttcacaaatatcccaaacaagatattcttttcaaacagggctccctctcagtggtcatgagggaaggttgataatgttctttgttggggactgtttatacaattttttttcaactgtgagctttggaatcgtaacttgctgtgagtccagcttctgtctactgccataagatggaccccacgtcagcataatgagggtggtatatatgctcgcacctagacatgcgcatatgtacctgtcgtaccttcacggaaggaaaacaggctactgacgtttcggaggagtagccaccagtgcctaatatcttttgggggggatggatgcttataattgccagtatatcgaaaccacactgggagttccacatagcggggaggggttgggggtgggcagaggggacattttaaacctaggcctttggactggaggcagaacgatttctgcaaacctaggtcctgaaggctttggggcttattggctggttctcaacctttttgttttttcttcccagcatgcatttcctatctaaacccagacttagtttaatttccttatctttcacttctgcttcattccagggaggaaaaatacacctgttaatggccaagatctccttgctaacacagaggcaaaaataaatgtctaatgtttttgaagcctccccttcctttccacaagcccccacccgcccccgcgtcaagctccttctcccacttcctactcccacacaacttcccagccactgaaacttttctttcaaatctctattatcctcttaacagttgcttgaataaatttatttttgcactatacattttctttttgccagatgtgtctaacaagtgtgtttggagagacctactcccagccccgtctccttccccgcctccccccgtcacattctctcaggccttctctggtatttataatatatcacagaagtacccagtcttatagccctcggttatgcctttttttgacattttattttttttaagctttttatatatatatatatataaatatattactttgtcaagtttttttgctgtacaaaagtcttaagatttaaaactattatttgtattatatgatggtggtatgttaatgttacaaaattattaatgaagaaaaaatttatttttgttactggtctgtttcataattcttttttaaattggtatattgtaagatatctatgcaaaaaatgttatgtgacgcatttttatttaagaatgtaatatgtgtaataaacagtagaatgtgtttggccttggaatactttactgtatttctccttagcttgtttcactggggaaaaaaatcttcgaaagacgcaagtgggtacttacatacttcgtgaaagttttctttcttggagaaagggaaagcaaaaggttgtattaggttatcttcgtttgggaagttgtgtgtgtgtgtgcgtatgtgtgtattttatagtttcattgaggcagctcaatgcccaaataagggtcactgagtttatttcttcaaggggaaaaagggagccaattgttggagattatgaaaagcaatattttagaatgatagagattacaagatgttatttgtttagggggttgggagaggcttattgaaagcggtttatttggcgagagaaggaggcagtttgttctgggatggtgtttaataggaacctattgggaaaggatctttgaagcagtctgtgaaggaggaagggtaaagatcagagggaataatttaggtgaggggtagggggcagtaaaatgacaggaggtggttggagtggggaggaaatgggtaaccggaagccaggaaatccagctggctgtggagagtacaaaaaactagatggaaatacaagcagcttcagacccagagaagagagggagatgaaagccccagggaaaattctcagaactgaaaagaaaagtactaaaatctctgccacacacgacttccaggaaagagcatcaccagtaaggaggaaggtagagaacccagctggtggtgtcgcctcagcatcccgagctcagcgattccccgagagaagtggtgtcattcacaggaaacagcagtaaaacacatttgtcacatgggacacagcagtagtcaagctttctttgcattctttggacttacagaagtggatacggtggtgaataacctctatccctaatcaaatgaatctgacaagaaactttccaataaatgtttactttagaaa

SEQ ID NO: 147079 - DNA, 3037 bp, Homo sapiens
  Payload ID: 9097
  Gene Symbol: KLF7
  Gene Name: Kruppel-like factor 7 (ubiquitous)
  Uniprot ID: O75840
  ENST ID: ENST00000421199
  CDS Start-End: 105-914
agatgtaacagatctctctatgtctacatcccaactccagaaaacgagaaatcgagttcctcctctcaccatcgaagctctgcagacacctcgctggagaccccatgacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttccttttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaa

SEQ ID NO: 147080 - DNA, 594 bp, Homo sapiens
  Payload ID: 9097
  Gene Symbol: KLF7
  Gene Name: Kruppel-like factor 7 (ubiquitous)
  ENST ID: ENST00000457962
  CDS Start-End: 413-594
attgtgcagggttttcatctcagatgtaacagatctctctatgtctacatcccaactccagaaaacgagaaatcgagttcctcctctcaccatcgaagctctgcagacacctcgctggagaccccatggtgagcctcatcacgtaaaggccccctcgcaagctgccggctccagcttgcgccccacgtctacctaggctccctctagcctctttaacgcacagtcgagcaacaggccccttgcaatcaactctagccgccggactcccgaccagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgttt

SEQ ID NO: 147081 - DNA, 539 bp, Homo sapiens
  Payload ID: 9097
  Gene Symbol: KLF7
  Gene Name: Kruppel-like factor 7 (ubiquitous)
  Uniprot ID: O75840
  ENST ID: ENST00000458272
  CDS Start-End: 4-342
agcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcact

SEQ ID NO: 147082 - DNA, 750 bp, Homo sapiens
  Payload ID: 9097
  Gene Symbol: KLF7
  Gene Name: Kruppel-like factor 7 (ubiquitous)
  ENST ID: ENST00000426163
  CDS Start-End: 413-750
acacgcggcctaatggacgccctcctcgagatcccacggctgcgcggagaaccgaacggagggagggagtttggggagggggaagagcaggaggaggagaaaagggagggggaagactacaaactagcaaggatggggtggggggtggggagggaagggaaggggggggaagagaagcgatcgcgagagaaaaaaatgcaacctcccaaaataaagagcaaagattgcattaggagcgaacagcgctgcagaaatagatggcagcttcgtgtcattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctcca

SEQ ID NO: 147083 - DNA, 1788 bp, Homo sapiens
  Payload ID: 9097
  Gene Symbol: KLF7
  Gene Name: Kruppel-like factor 7 (ubiquitous)
  Uniprot ID: O75840
  ENST ID: ENST00000423015
  CDS Start-End: 230-922
cacttcctcctcaggcgcttcttctctgcaccctggcagcccgtggggagttcgggaaggggccctggatgccttttctgcttgtttttgattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaa

SEQ ID NO: 147084 - DNA, 7954 bp, Homo sapiens
  Payload ID: 9097
  Gene Symbol: KLF7
  Gene Name: Kruppel-like factor 7 (ubiquitous)
  Uniprot ID: O75840
  ENST ID: ENST00000412414
  CDS Start-End: 54-878
agcctgtgcaagtgatttgggagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaaggagggctgggggctgaagcatgtcccgaaaacaagaagagggttcaccgctgtcagtttaacgggtgccggaaagtttatacaaaaagctcccacttaaaggcccaccagaggactcacacaggtgagaagccttataagtgctcatgggagggatgtgagtggcgttttgcacgaagcgatgagctcacgaggcactacaggaaacacacaggtgcaaagcccttcaaatgcaaccactgcgacaggtgtttttccaggtctgaccatcttgccctccacatgaagagacatatctaaaaaaccgaaaggccagagttgccatggcatcggctagtgtctaaaggaaacgccatgaggcagggggctggacttcaggcggggacccattgcctcgcagaagaaagttctcacttataaacctctgtacacacacacacacacacacacatatacacacactcacagacccacacacatacacactgtcatgcactcaactatatttaaaatatatacgtctattctttatgccttgccctagccagatggaagaagatgaagaaggaaaccaggtgaactcagcaaggcagactggctgcttacttcagcactattggaattatttcccgctgttgccaatggaaatcaaagaaaatggatgtgacgtctgtgcaggtggacggcagtccgaggggcttatttcacttgcttctcagtgcaacttgataggagaatccagcatcttaaagttgcatatgtgtagcactaatgtttctttttaaatagttgggggaaaatgacctagaaaaccaaattgcagtttggtagccaaaattaactcttggtttatttgtcctttgtgtgtgaaaagtcctactattccgtgcgtcagacttcctcacagaactgttgactggttttggttcttagtactattgagatctttcgcgtcgatcccaacggccttagcggcggcagactggaataacaccttacacctttctggcctgcatttctgtagacttcactctcaagggaggagttttcttttcttacgttttgacttttgcacaccatatgcactagggattctggaaacttctagcatgactgcaaagtggccaagagaataaagtccttgatgataaatcacagtatatcccttgagcctcaccttattgccagtgctagattttttctttttaatctctccgtttttgctaacgaaaacttgaaaagcttatttggaagcttaaatgttttatcttttctccatggactaaacctctccaggactctctcggcacctggatgtccagctctcgaagcagccagtcagatgggacatcacagttctctcatcctccttgaggcatgatgacctcagctcatagtgatcaaccgttgtgctgtgtgtcattgctaccccataaccagttacagcatagatgtcgctagtctcagagggcagctgcgtatttaatttaactctggtttatgacctgacaaaaagccaaaaatatcactctttccaggagtggggaaaactgaggatgcctcccaagtctagtggcttcacaaaagatcatcctgtcttctctgtcatgcccactgagctcctattcccctacgtgttacaatacacaatttaaaacgccattgtgggagtgaagggttgacatttaaggaaaaggttgaggtgtttctctcatgggctgtctaaaaggagagacacgtttctttctttccttttttttttggctaggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaacaaaataatacaaaacgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctattttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagccgagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaacccggcctggtgtttctggtggtgtcctaacaagcacgcttttatccagggttcagatttgttcatgtagaaaaagagtttctaagccactgacaattttttttttttgtaatttcaaattatacttctttctcctgccacatgactgtaagtcatagacatggaaacctgaaattataatgctgctcctagctactggcctcctgccccacccatggttaatggctcagctcaatgcctggtggtaatgagtattatgtccagaaaaagagatgttcagattccatgacaaagctgcatttttgtaaaaatattggagaccccaaaatgaacttcatgctgaccatttcctcctctctgtgtgctttcccttgcaaagcccttcaaatatcctcttctctcgacgccatctcctctccacctgcacctcttgtgccctttgtacatctttgattgcctgatgataacagggtaaaaggacagccaacctcatgcctgattagcagaactgaatcctagttttaaaaaatcttctctggcttcagagaagattttataaggacttttgtttgggataagctttccagattatccatgtctatttgcatcaaaggggaaagaaatggggcttttggatggctcttccagtgcattcggaacattgcctcttgcctttattcctgcattttatggcaaagccaaaagaaactcaagttgcaagaacaaaacccagtgactcgttttgatggttcaaaatggtttcctttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatcccagaaaagggaaaaataaagctgcagttaactttcttatgtgcatccttccaatagagtactgtatttttcaggtgttttgcatttaacataaaagtcctcgggaaacaggtgtcaaaaacagagagagaaatcctgggccatcacttcacaaatatcccaaacaagatattcttttcaaacagggctccctctcagtggtcatgagggaaggttgataatgttctttgttggggactgtttatacaattttttttcaactgtgagctttggaatcgtaacttgctgtgagtccagcttctgtctactgccataagatggaccccacgtcagcataatgagggtggtatatatgctcgcacctagacatgcgcatatgtacctgtcgtaccttcacggaaggaaaacaggctactgacgtttcggaggagtagccaccagtgcctaatatcttttgggggggatggatgcttataattgccagtatatcgaaaccacactgggagttccacatagcggggaggggttgggggtgggcagaggggacattttaaacctaggcctttggactggaggcagaacgatttctgcaaacctaggtcctgaaggctttggggcttattggctggttctcaacctttttgttttttcttcccagcatgcatttcctatctaaacccagacttagtttaatttccttatctttcacttctgcttcattccagggaggaaaaatacacctgttaatggccaagatctccttgctaacacagaggcaaaaataaatgtctaatgtttttgaagcctccccttcctttccacaagcccccacccgcccccgcgtcaagctccttctcccacttcctactcccacacaacttcccagccactgaaacttttctttcaaatctctattatcctcttaacagttgcttgaataaatttatttttgcactatacattttctttttgccagatgtgtctaacaagtgtgtttggagagacctactcccagccccgtctccttccccgcctccccccgtcacattctctcaggccttctctggtatttataatatatcacagaagtacccagtcttatagccctcggttatgcctttttttgacattttattttttttaagctttttatatatatatatatataaatatattactttgtcaagtttttttgctgtacaaaagtcttaagatttaaaactattatttgtattatatgatggtggtatgttaatgttacaaaattattaatgaagaaaaaatttatttttgttactggtctgtttcataattcttttttaaattggtatattgtaagatatctatgcaaaaaatgttatgtgacgcatttttatttaagaatgtaatatgtgtaataaacagtagaatgtgtttggccttggaatactttactgtatttctccttagcttgtttcactggggaaaaaaatcttcgaaagacgcaagtgggtacttacatacttcgtgaaagttttctttcttggagaaagggaaagcaaaaggttgtattaggttatcttcgtttgggaagttgtgtgtgtgtgtgcgtatgtgtgtattttatagtttcattgaggcagctcaatgcccaaataagggtcactgagtttatttcttcaaggggaaaaagggagccaattgttggagattatgaaaagcaatattttagaatgatagagattacaagatgttatttgtttagggggttgggagaggcttattgaaagcggtttatttggcgagagaaggaggcagtttgttctgggatggtgtttaataggaacctattgggaaaggatctttgaagcagtctgtgaaggaggaagggtaaagatcagagggaataatttaggtgaggggtagggggcagtaaaatgacaggaggtggttggagtggggaggaaatgggtaaccggaagccaggaaatccagctggctgtggagagtacaaaaaactagatggaaatacaagcagcttcagacccagagaagagagggagatgaaagccccagggaaaattctcagaactgaaaagaaaagtactaaaatctctgccacacacgacttccaggaaagagcatcaccagtaaggaggaaggtagagaacccagctggtggtgtcgcctcagcatcccgagctcagcgattccccgagagaagtggtgtcattcacaggaaacagcagtaaaacacatttgtcacatgggacacagcagtagtcaagctttctttgcattctttggacttacagaagtggatacggtggtgaataacctctatccctaatcaaatgaatctgacaagaaactttccaataaatgtttactttagaaa

SEQ ID NO: 147085 - DNA, 574 bp, Homo sapiens
  Payload ID: 9097
  Gene Symbol: KLF7
  Gene Name: Kruppel-like factor 7 (ubiquitous)
  ENST ID: ENST00000451244
  CDS Start-End: 202-357
taaagagcaaagattgcattaggagcgaacagcgctgcagaaatagatggcagcttcgtgtcattgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcagaaaattattgaagatcatctccaaaaagaaaacacaccagtttcttattattgactatgaaatcaacatgactgggtgggactggggaaaagacagatttatcagtccctaagagctgatggaaactgcatcctttaggtggaacacagagttggctgtaaggagacattcctttgtttttgttgtcttgaacaaaaggaaggacagtagatgacacagacatgccttgaattggaacgctacctacagacggagccccggaggatctcag

SEQ ID NO: 147086 - DNA, 578 bp, Homo sapiens
  Payload ID: 9097
  Gene Symbol: KLF7
  Gene Name: Kruppel-like factor 7 (ubiquitous)
  ENST ID: ENST00000435602
  CDS Start-End: 54-578
agcctgtgcaagtgatttgggagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtgcattgaggaaagcttccgtcgcttagaccccctgctgctccccgtggaagcggccatctgtgagaagagctcggcagtggacatcttgctctctcgggacaagttgctatctgagacctgcctcagcctccagccggccagctcttctctagacagctacacagccgtcaaccaggcccagctcaacgcagtgacctcattaacgcccccatcgtcccctgagctcagccgccatctggtcaaaacctcacaaactctctctgccgtggatggcacggtgacgttgaaactggtggccaagaaggctgctctcagctccgtaaaggtgggaggggtcgcaacagctgcagcagccgtgacggctgcgggggccgttaagagtggacagagcgacagtgaccaa

SEQ ID NO: 147087 - DNA, 4821 bp, Homo sapiens
  Payload ID: 9098
  Gene Symbol: KLF8
  Gene Name: Kruppel-like factor 8
  Uniprot ID: O95600
  ENST ID: ENST00000374928
  CDS Start-End: 487-1260
tcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtgcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagagagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaa

SEQ ID NO: 147088 - DNA, 1543 bp, Homo sapiens
  Payload ID: 9098
  Gene Symbol: KLF8
  Gene Name: Kruppel-like factor 8
  Uniprot ID: O95600
  ENST ID: ENST00000468660
  CDS Start-End: 289-1368
cccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagaaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatat

SEQ ID NO: 147089 - DNA, 1908 bp, Homo sapiens
  Payload ID: 9098
  Gene Symbol: KLF8
  Gene Name: Kruppel-like factor 8
  ENST ID: ENST00000358094
  CDS Start-End: 147-833
acgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcaggagcacaaaggccaaggtggatgttctcacatctggactaatcctagaatttgattttaggacagccaggagctattcatgaaagttgaccccacctccatgtctccactggaaattccaagtgacagtgaggagagtacaattgagagtggatcctcagccttgcagagtctgcagggactacagcaagaaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaa

SEQ ID NO: 147090 - DNA, 1150 bp, Homo sapiens
  Payload ID: 9098
  Gene Symbol: KLF8
  Gene Name: Kruppel-like factor 8
  ENST ID: ENST00000635281
  CDS Start-End: 65-823
cctgcgctatgtcagaatggggcgggtgtgaggggaacagctctcttgcgatcagctcaggagtatgagcctcccggaggacggcatgagttctggacacttcaggagtcctcagctagtgacatggtcggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagagagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgt

SEQ ID NO: 147091 - DNA, 5175 bp, Homo sapiens
  Payload ID: 9099
  Gene Symbol: KLF9
  Gene Name: Kruppel-like factor 9
  Uniprot ID: Q13886
  ENST ID: ENST00000377126
  CDS Start-End: 1262-1996
tgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaagactgaa

SEQ ID NO: 147092 - DNA, 1714 bp, Homo sapiens
  Payload ID: 9100
  Gene Symbol: KTI12
  Gene Name: KTI12 chromatin associated homolog
  Uniprot ID: Q96EK9
  ENST ID: ENST00000371614
  CDS Start-End: 56-1120
gcgtacaacccggaagttggcgcagcgcggttgccaatggtcgctccctgagaggatgccgctcgtggtgttttgcgggctgccgtacagcggcaagagccggcgtgctgaagagttgcgcgtggcgctggctgccgagggccgcgcggtgtacgtggtggacgacgcagctgtcctgggcgcagaggacccagcggtgtacggcgattctgcccgtgagaaggcattgcgtggagctctgcgagcctccgtggaacggcgcctgagtcgccacgacgtggtcatcctggactcgcttaactacatcaaaggtttccgttacgagctctactgcctggcacgggcggcgcgcaccccgctctgcctggtctactgcgtacggcccggcggcccgatcgcgggacctcaggtggcgggcgcgaacgagaaccctggccggaacgtcagtgtgagttggcggccacgcgctgaggaggacgggagagcccaggcggcgggcagcagcgtcctcagggaactgcatactgcggactctgtagtaaatggaagtgcccaggccgacgtacccaaggaactggagcgagaagaatccggggctgcggagtctccagctcttgtgactccggattcagagaaatctgcaaagcatgggtccggtgccttttactctcccgaactcctggaggccctaacgctgcgctttgaggctcccgattctcggaatcgctgggaccggcctttattcactttggtgggcctagaggagccgttgcccctggcggggatccgctctgccctgtttgagaaccgggccccaccaccccatcagtctacgcagtcccagcccctcgcctccggcagctttctgcaccagttggaccaggtcacgagtcaagtactggccggattgatggaagcgcagaagagcgctgtccccggggacttgctcacgcttcctggtaccacagagcacttgcggtttacccggcccttgaccatggcagaactgagtcgccttcgtcgccagtttatttcgtacactaaaatgcatcccaacaatgagaacttgccgcaactggccaacatgtttcttcagtatttgagccagagcctgcactgaccagaggaggtaggggggaagccatggcttctgatctccactccactttatttctctgggaaaaataggctgcaggtctccagagcatatcgatgcagtactgtactagagctgttgtgactgattcactcaaactttcctgcatacccctgtgccaggccttgggtttacagcataagttcagactaaagagaatggagaactattgtggtgcaacctggcaaatccctcagaggacagagctaaggtggacagggattacctagattggatcctacttgggctatcacagagcattgaccattggcttccctcatctgaggcgtgggagagcagactggatagatgagaattgttttaaaacaattgtgaacagaaactgaagatggtacagttctacatctgcacctgcccttttttcataccacaaaagtattttttgagtactgtactgactttttgctagtttctattctgggaccgagttcacagataaatccattggtttgtatccttgagaaactttgtttttgtggaagtaagaaagttatctactagattatttcctctaataaaatcttttaaaatagtcta

SEQ ID NO: 147093 - DNA, 2014 bp, Homo sapiens
  Payload ID: 9101
  Gene Symbol: KCNIP1
  Gene Name: Kv channel interacting protein 1
  ENST ID: ENST00000328939
  CDS Start-End: 538-1188
gctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctcaa

SEQ ID NO: 147094 - DNA, 1197 bp, Homo sapiens
  Payload ID: 9101
  Gene Symbol: KCNIP1
  Gene Name: Kv channel interacting protein 1
  Uniprot ID: Q9NZI2
  ENST ID: ENST00000377360
  CDS Start-End: 391-1068
aagaaagacagtcagcaaagcctgggagagctccagctcctccctccctgctctgctcaacttcactctcctcctcggttcccttggagtaccttgtgccccggcagtgctgtcccggccctggcatcctgaggtcctcccgtggtgaggacttaagtggacagcaggagtgggtggagagagggagggagagtttgccctgcaggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaaga

SEQ ID NO: 147095 - DNA, 2249 bp, Homo sapiens
  Payload ID: 9101
  Gene Symbol: KCNIP1
  Gene Name: Kv channel interacting protein 1
  ENST ID: ENST00000390656
  CDS Start-End: 763-1425
gctggcagcaggcagcaggcagcaggcgggcgcgctgtggctccgcgccgcgcggtccgggctctgttcattcatgattggtactcggccctccgagacccagcccgagcgcagggaggggagccgagtgtgcggcaggaggggcgggcggacggcggctcccgcaccgcacgcggcgctggctcggcagcctcggccgggcggccgctctggccccgtgtccagtgccaggcaggcttcagggcaccgtcctcggccctgggcgagggaaccgccgggccgggtcctcgcgcggggaagcggttccgaaggctcgcggggagcggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctggataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctc

SEQ ID NO: 147096 - DNA, 684 bp, Homo sapiens
  Payload ID: 9101
  Gene Symbol: KCNIP1
  Gene Name: Kv channel interacting protein 1
  Uniprot ID: Q9NZI2
  ENST ID: ENST00000411494
  CDS Start-End: 1-684
atgggggccgtcatgggcaccttctcatctctgcaaaccaaacaaaggcgaccctcgaaagacatcgcctggtggtattaccagtatcagagagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 147097 - DNA, 726 bp, Homo sapiens
  Payload ID: 9101
  Gene Symbol: KCNIP1
  Gene Name: Kv channel interacting protein 1
  Uniprot ID: Q9NZI2
  ENST ID: ENST00000434108
  CDS Start-End: 1-726
atgggggccgtcatgggcaccttctcatctctgcaaaccaaacaaaggcgaccctcgaaagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagccctgccttgtttggaaggttctccctgtgtggaattcctgcccccatcacctgccctccttttctgccttgtagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaa

SEQ ID NO: 147098 - DNA, 639 bp, Homo sapiens
  Payload ID: 9101
  Gene Symbol: KCNIP1
  Gene Name: Kv channel interacting protein 1
  ENST ID: ENST00000517344
  CDS Start-End: 189-317
caggctctctggatgcagaagccagactcgctgcagaggcagctgtgctgttcccggagcctggcttcaggggtgcatccgtcactcagggttcattcacccaggcaggctccaagttcctggggtgcacaaggtgggcactgtcccttctgggtgctgacagcagagcctggctcccctccgccaccatgagcggctgctccaaaagatgcaagcttgggttcgtgaaatttgcccagaccatctttaagctcatcactgggaccctcagcaaagatggagtcaaaagtggaactggggcccgcagagccggatagcttgggcagtacgtgtgtgcacctgcaggctgtggagacaggtatttccatggagctcactcgccctgcctctcatccaggcctgaaaatcatagagcatcccgctggccatctgcatcagcccgacccccacaggatagaagactggcacatccaagttgctccttccacaccctctccccactgaggcctcgtctcctccgccctgtggccaattgaagactcagcatcatcaagactggagggacagagcatttgaatcatcagacgctgggccagacgtcaccccacgcgttttctcattttatcgtcctaagaagcc

SEQ ID NO: 147099 - DNA, 1845 bp, Homo sapiens
  Payload ID: 9101
  Gene Symbol: KCNIP1
  Gene Name: Kv channel interacting protein 1
  Uniprot ID: Q9NZI2
  ENST ID: ENST00000520740
  CDS Start-End: 460-1026
ggctagccctgagtccctgcatgtgcggggctgaagaaggaagccagaagcctcctagcctcgcctccacgcttgctgaataccaagctgcaggcgagctgccgggcgcttttctctcctccaattcagagtagacaaaccacggggatttctttccagggtaggggaggggccgggcccggggtcccaactcgcactcaagtcttcgctgccatgggggccgtcatgggcaccttctcatctctgcaaaccaaacaaaggcgaccctcgaaagaactaccttaaattaatttgttgaaaggacagatggatggatggttgatggaagtagcaggcttccagcagcaggggatggagtgagtgtgtggataccgctggatcagcagaaggttataccattttagagtaactatctcggacttcggagagttcctggataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttaca

SEQ ID NO: 147100 - DNA, 1448 bp, Homo sapiens
  Payload ID: 9101
  Gene Symbol: KCNIP1
  Gene Name: Kv channel interacting protein 1
  ENST ID: ENST00000616807
  CDS Start-End: 1-624
gacatcgcctggtggtattaccagtatcagagagataagattgaagatgagctggagatgaccatggtttgccatcggcccgagggactggagcagctcgaggcccagaccaacttcaccaagagggagctgcaggtcctttatcgaggcttcaaaaatgagtgccccagtggtgtggtcaacgaagacacattcaagcagatctatgctcagtttttccctcatggagatgccagcacgtatgcccattacctcttcaatgccttcgacaccactcagacaggctccgtgaagttcgaggactttgtaaccgctctgtcgattttattgagaggaactgtccacgagaaactaaggtggacatttaatttgtatgacatcaacaaggacggatacataaacaaagaggagatgatggacattgtcaaagccatctatgacatgatggggaaatacacatatcctgtgctcaaagaggacactccaaggcagcatgtggacgtcttcttccagaaaatggacaaaaataaagatggcatcgtaactttagatgaatttcttgaatcatgtcaggaggacgacaacatcatgaggtctctccagctgtttcaaaatgtcatgtaactggtgacactcagccattcagctctcagagacattgtactaaacaaccaccttaacaccctgatctgcccttgttctgattttacacaccaactcttgggacagaaacaccttttacactttggaagaattctctgctgaagactttctatggaacccagcatcatgtggctcagtctctgattgccaactcttcctctttcttcttcttgagagagacaagatgaaatttgagtttgttttggaagcatgctcatctcctcacactgctgccctatggaaggtccctctgcttaagcttaaacagtagtgcacaaaatatgctgcttacgtgcccccagcccactgcctccaagtcaggcagaccttggtgaatctggaagcaagaggacctgagccagatgcacaccatctctgatggcctcccaaaccaatgtgcctgtttctcttcctttggtgggaagaatgagagttatccagaacaattaggatctgtcatgaccagattgggagagccagcacctaacatatgtgggataggactgaattattaagcatgatattgtctgatgacccaaactgcccatgtcatttgtttccagaaacgaggaccaataattctctcacactggcatttgtgctggtagtacaagtcctttaatatgtccaggaagggagccattgcccagtggtccatatctccaccacatcccctgcttgagcccagcgctgcatgtccctcccaagaagtccagaatgcctgcaaattgctgtaattttataccatgttctaaccaataaacagaactatttcttacactctc

SEQ ID NO: 147101 - DNA, 555 bp, Homo sapiens
  Payload ID: 9102
  Gene Symbol: KCNIP2
  Gene Name: Kv channel interacting protein 2
  Uniprot ID: Q9NS61
  ENST ID: ENST00000239117
  CDS Start-End: 1-555
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggtacagctccctgccctctacattaccctgacctggactcaggcctga

SEQ ID NO: 147102 - DNA, 2089 bp, Homo sapiens
  Payload ID: 9102
  Gene Symbol: KCNIP2
  Gene Name: Kv channel interacting protein 2
  Uniprot ID: Q9NS61
  ENST ID: ENST00000348850
  CDS Start-End: 33-710
tggagcttagacgccgagctcgccgccaaaccatgaaccgatgcccccgcaggtgccggagcccgctggggcaggcagcgcgatccctctaccagctggtgactgggtcgctgtccccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgca

SEQ ID NO: 147103 - DNA, 684 bp, Homo sapiens
  Payload ID: 9102
  Gene Symbol: KCNIP2
  Gene Name: Kv channel interacting protein 2
  Uniprot ID: Q9NS61
  ENST ID: ENST00000353068
  CDS Start-End: 1-684
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaaccctggtgccctctccttccaggaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 147104 - DNA, 663 bp, Homo sapiens
  Payload ID: 9102
  Gene Symbol: KCNIP2
  Gene Name: Kv channel interacting protein 2
  Uniprot ID: Q9NS61
  ENST ID: ENST00000343195
  CDS Start-End: 1-663
atgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 147105 - DNA, 1989 bp, Homo sapiens
  Payload ID: 9102
  Gene Symbol: KCNIP2
  Gene Name: Kv channel interacting protein 2
  Uniprot ID: Q9NS61
  ENST ID: ENST00000356640
  CDS Start-End: 277-1089
gagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaacattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctc

SEQ ID NO: 147106 - DNA, 2489 bp, Homo sapiens
  Payload ID: 9102
  Gene Symbol: KCNIP2
  Gene Name: Kv channel interacting protein 2
  Uniprot ID: Q9NS61
  ENST ID: ENST00000358038
  CDS Start-End: 353-1111
aaagggtggggggcgggggtagggggagccaatcccggcagcgccaaagaggggaggaggcggtgacagccgcggggagggggcgggaggagagaggcagctcggctcggctccgcgctcagctccgctctgcctccggctctgcgctcacctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaaacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcattttgggctcttctatatattttgtaaagtaagaaatataccagatctaataaaacacaatggctatgc

SEQ ID NO: 147107 - DNA, 923 bp, Homo sapiens
  Payload ID: 9102
  Gene Symbol: KCNIP2
  Gene Name: Kv channel interacting protein 2
  ENST ID: ENST00000370046
  CDS Start-End: 202-756
ctgctgcctagtgttccctctcctgctccaggacctccgggtagacctcagaccccgggcccattcccagactcagcctcagcccggacttccccagccccgacagcacagtaggccgccagggggcgccgtgtgagcgccctatcccggccacccggcgccccctcccacggcccgggcgggagcggggcgccgggggccatgcggggccagggccgcaaggagagtttgtccgattcccgagacctggacggctcctacgaccagctcacggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctagcccccaggagagggggtcagtgtttcctggggggaccatgctctaaccctagtccaggcggacctcacccttctcttcccaggtctatcctcatcctacgcctccctgggggctggagggatccaagagcttggggattcagtagtccagatctctggagctgaagg

SEQ ID NO: 147108 - DNA, 534 bp, Homo sapiens
  Payload ID: 9102
  Gene Symbol: KCNIP2
  Gene Name: Kv channel interacting protein 2
  Uniprot ID: Q9NS61
  ENST ID: ENST00000434163
  CDS Start-End: 1-534
atgtggcttagctggacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 147109 - DNA, 858 bp, Homo sapiens
  Payload ID: 9102
  Gene Symbol: KCNIP2
  Gene Name: Kv channel interacting protein 2
  Uniprot ID: Q9NS61
  ENST ID: ENST00000461105
  CDS Start-End: 1-858
atgcggggccagggccgcaaggagagtttgtccgattcccgagacctggacggctcctacgaccagctcacgggccaccctccagggcccactaaaaaagcgctgaagcagcgattcctcaagctgctgccgtgctgcgggccccaagccctgccctcagtcagtgaaattggccgggtcttccgctttctcggtgacagttcgctcccttcagcattagccgccccagcctccctccgcccccacagaccccgcctgctggacccagacagcgtggacgatgaatttgaattgtccaccgtgtgtcaccggcctgagggtctggagcagctgcaggagcaaaccaaattcacgcgcaaggagttgcaggtcctgtaccggggcttcaagaacgaatgtcccagcggaattgtcaatgaggagaacttcaagcagatttactcccagttctttcctcaaggagactccagcacctatgccacttttctcttcaatgcctttgacaccaaccatgatggctcggtcagttttgaggactttgtggctggtttgtccgtgattcttcggggaactgtagatgacaggcttaattgggccttcaacctgtatgaccttaacaaggacggctgcatcaccaaggaggaaatgcttgacatcatgaagtccatctatgacatgatgggcaagtacacgtaccctgcactccgggaggaggccccaagggaacacgtggagagcttcttccagaagatggacagaaacaaggatggtgtggtgaccattgaggaattcattgagtcttgtcaaaaggatgagaacatcatgaggtccatgcagctctttgacaatgtcatctag

SEQ ID NO: 147110 - DNA, 2940 bp, Homo sapiens
  Payload ID: 9103
  Gene Symbol: KCNIP3
  Gene Name: Kv channel interacting protein 3, calsenilin
  Uniprot ID: Q9Y2W7
  ENST ID: ENST00000295225
  CDS Start-End: 136-906
gagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggagaggga

SEQ ID NO: 147111 - DNA, 2798 bp, Homo sapiens
  Payload ID: 9103
  Gene Symbol: KCNIP3
  Gene Name: Kv channel interacting protein 3, calsenilin
  ENST ID: ENST00000360990
  CDS Start-End: 1-771
atgcagccccggaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaagg

SEQ ID NO: 147112 - DNA, 985 bp, Homo sapiens
  Payload ID: 9103
  Gene Symbol: KCNIP3
  Gene Name: Kv channel interacting protein 3, calsenilin
  Uniprot ID: Q9Y2W7
  ENST ID: ENST00000468529
  CDS Start-End: 293-985
gccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagccgtcgccgcccccgagaggccgtgcgggctgcaggggccccggtgcctccgaggcagcgcgtgggcgaggggtgcgcccgggccccagggccccaggcagcccggcttgccatgggcatccagggcatggagctgtgcgccatggccgtggtggtgctgctgttcatcgccgtcctcaagcagttcggcatcctggagcccatatccatggaagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctag

SEQ ID NO: 147113 - DNA, 2168 bp, Homo sapiens
  Payload ID: 9104
  Gene Symbol: KCNIP4
  Gene Name: Kv channel interacting protein 4
  Uniprot ID: Q6PIL6
  ENST ID: ENST00000359001
  CDS Start-End: 136-702
gtggacagtcacagacattagcagacatgttcttccgttttcctttgttgctctgtgtaagcatcggtgagcagtggctggtcctaagactctttcttgttttcctccacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtt

SEQ ID NO: 147114 - DNA, 2481 bp, Homo sapiens
  Payload ID: 9104
  Gene Symbol: KCNIP4
  Gene Name: Kv channel interacting protein 4
  Uniprot ID: Q6PIL6
  ENST ID: ENST00000382148
  CDS Start-End: 338-1015
aactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagtaatcctaacagcattaaaggccaaatctgtcctctttcccctgacttccttacagcatgtttatttatattacaagccattcagggacaaagaaagaaaccttgactaccccactgtctactaagaacaaacagcaagcaaaattagcaagcaaaattcactttgaaagcaccagtggttccattacattgacaactactaccaagatttagtagaaaataagtgctcaacaactaatccagattacagtatgatttagctcatcataattcagattatttttaatcatcttagccaaaactgtaaagttgccacattactaaagccacacacatcgtccctgttttgtagaaatatcacaaagaccaagaggctacagaaggaggaaatttgcaactgtctttgcaacaataaatcaggtatctattctggtgtagagataggatgttgaaagctgccctgctatcaccagtgtagaaattaagagtagtacaatacatgtacactgaaatttgccatcacgtgtttgtgtaaactcaatgtgcacattttgtatttcaaaaagaaaaaataaaagcaaaataaaatgtt

SEQ ID NO: 147115 - DNA, 1645 bp, Homo sapiens
  Payload ID: 9104
  Gene Symbol: KCNIP4
  Gene Name: Kv channel interacting protein 4
  Uniprot ID: Q6PIL6
  ENST ID: ENST00000382150
  CDS Start-End: 84-773
aatgtagtttaatggctttacaaagaaagccaggcagaggagcacttctcagtggctgtggtcggaccatgacctagctgaccatgaacttggaagggcttgaaatgatagcagttctgatcgtcattgtgctttttgttaaattattggaacagtttgggctgattgaagcaggtttagaagacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataaca

SEQ ID NO: 147116 - DNA, 1767 bp, Homo sapiens
  Payload ID: 9104
  Gene Symbol: KCNIP4
  Gene Name: Kv channel interacting protein 4
  Uniprot ID: Q6PIL6
  ENST ID: ENST00000382152
  CDS Start-End: 169-921
ctgcagcccgctccgcgcgccctgcccgcagccgccgccgaagctctcgctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcct

SEQ ID NO: 147117 - DNA, 1641 bp, Homo sapiens
  Payload ID: 9104
  Gene Symbol: KCNIP4
  Gene Name: Kv channel interacting protein 4
  Uniprot ID: Q6PIL6
  ENST ID: ENST00000447367
  CDS Start-End: 115-765
agcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctacaggcgacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttgaatgctgtaattccatttaaattccatttatatactttaaggaaacaagattacaacaattaaaaaaacacatagttccagtttctatggccttcccaccttctgttagaaattagttttatctggcatttttaaacatttaaaaattattaaacatttaaaaattagtttattatcagatatcagcatatgcctaataaaacttattttaataagcatttaattttccataatatgttacagccaaggcctatataataattttggatttgttcaatctttcttacaggctgttttctattgtatcaatcattagtatcaatcattaagtggaagttgaagaaggcatcaaacaaaacaaggatgtttacagacatatgcaaagggtcaggatatctatcctccagtatatagtaatgcttaataacaagta

SEQ ID NO: 147118 - DNA, 1301 bp, Homo sapiens
  Payload ID: 9104
  Gene Symbol: KCNIP4
  Gene Name: Kv channel interacting protein 4
  Uniprot ID: Q6PIL6
  ENST ID: ENST00000509207
  CDS Start-End: 291-857
aagatggaggctctgtgtgagaaggaatgcagggcagcctctggttgcagagagcagcacccggtttgacagctagcaatgcaattgtgacctcagacctacaatgtcaaggaattggcttctgccaacaaccagaatgagcatgaaagtggattagtccttggaacttccagataagagcccagccagctatacttggatttcagcctgtgagattctcagcagagaacccagtcaagtgtgtccagacgtccaacctacagaactacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagttttattggttccttagccatgggattattgaggctttcacatatcagtgattttaaaatatcagtgttttttgctactcatttgtatgtattcagtcctaggattttgaatggttttctaatatagtgacatctgcatttaatttccagaaattaaattaattttcatgtttga

SEQ ID NO: 147119 - DNA, 763 bp, Homo sapiens
  Payload ID: 9104
  Gene Symbol: KCNIP4
  Gene Name: Kv channel interacting protein 4
  ENST ID: ENST00000515786
  CDS Start-End: 1-105
atgaatgtgaggagggtggaaagcatttcggctcagctggaggaggccagctctacaggcgaagcggttattgagcattcgctgtgtaccaagtgctgtccttgacaagaagacttacacccagtggtcccagagggagacttcggaagtgggagcacctgtcagatcatcatacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaa

SEQ ID NO: 147120 - DNA, 425 bp, Homo sapiens
  Payload ID: 9104
  Gene Symbol: KCNIP4
  Gene Name: Kv channel interacting protein 4
  ENST ID: ENST00000629040
  CDS Start-End: 338-425
aactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgttgcttaagatgagtggctgtagaaagcggtgtaaacgtgaaatactgaaatttgcccagtaccttctcagactattaacaggttctcttcatacag

SEQ ID NO: 147121 - DNA, 1426 bp, Homo sapiens
  Payload ID: 9105
  Gene Symbol: KXD1
  Gene Name: KxDL motif containing 1
  Uniprot ID: Q9BQD3
  ENST ID: ENST00000222307
  CDS Start-End: 149-679
gacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaa

SEQ ID NO: 147122 - DNA, 1496 bp, Homo sapiens
  Payload ID: 9105
  Gene Symbol: KXD1
  Gene Name: KxDL motif containing 1
  Uniprot ID: Q9BQD3
  ENST ID: ENST00000539106
  CDS Start-End: 210-740
gtctaagccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggtgccgccgctaccgacgccggggccgagtttggggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacaccta

SEQ ID NO: 147123 - DNA, 1592 bp, Homo sapiens
  Payload ID: 9105
  Gene Symbol: KXD1
  Gene Name: KxDL motif containing 1
  Uniprot ID: Q9BQD3
  ENST ID: ENST00000540691
  CDS Start-End: 306-836
gtctaagccccgccctttcctgtcgtgacttaacgcacgcaagcggctccagggtacgtccccgccacgcgcgctcgcaggatcggtgcgtggtgacgtttcgccggcgcgggcgccatcccggaagcgcgagcaaggccgccagatgtgcaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaagtacaccta

SEQ ID NO: 147124 - DNA, 932 bp, Homo sapiens
  Payload ID: 9105
  Gene Symbol: KXD1
  Gene Name: KxDL motif containing 1
  ENST ID: ENST00000598830
  CDS Start-End: 538-924
ctccagcctgggtgacaggagtgaaactctgtatcaaaaagaaataaaaaaacgaggtcaagtagtaagagaagcggtaagagtgacgggaacaggagtcattgacctcttgggagaggagacattggaggtggtgatgatttgctgaagcagccacacacgttcagcttgtgaggacagcagttgttaggcaggggatgagggaggaagctggcagatctgtgcaggtgagaggtacctgtggccttgggctcatggaagtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccgtaagtgtcacgcagggttcctgctcccgagcacgtcagcactctccacccagggcaggcttctggaaggccaccttggggcctgatactgaga

SEQ ID NO: 147125 - DNA, 686 bp, Homo sapiens
  Payload ID: 9105
  Gene Symbol: KXD1
  Gene Name: KxDL motif containing 1
  ENST ID: ENST00000595870
  CDS Start-End: 278-686
gtgggaggtgatgggattctaatgtgcttgggtacagtttacaaatacaacctctcttagtttgcccaatacctccaaattcctggggtggcacacctgaggttcaggtggcatgactgagccacagtcacacatccccactgtaggataccaccacggttgggttaggttccagcacatggcggtcccggcctggcctcttggtcccacctcacctggtgactagtgcagaccactctgttcttgcctgtttcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacacca

SEQ ID NO: 147126 - DNA, 707 bp, Homo sapiens
  Payload ID: 9105
  Gene Symbol: KXD1
  Gene Name: KxDL motif containing 1
  Uniprot ID: Q9BQD3
  ENST ID: ENST00000599319
  CDS Start-End: 88-618
ggagaaacagcctgtcctgagctccagtcgttatcacctttggtttcagttgccacagacagcactgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggct

SEQ ID NO: 147127 - DNA, 712 bp, Homo sapiens
  Payload ID: 9105
  Gene Symbol: KXD1
  Gene Name: KxDL motif containing 1
  ENST ID: ENST00000596785
  CDS Start-End: 490-712
ggccgccagatgtgcaggttcaagccattctcctgcctcagccatccaagtagctgcgactacaggtgcccgccaccatgcccggctaattttttttgtatttttagtagagactgagtttcactatgttggccaggctggttttgaactcctgacctcaagcagtctgcccacctcggcctcccaaagtgctaggattacagacgtgagccaccacacccggcctctgaaaccctttctgatccagtagaagttcgtctctgtttcttggctattaaatgtgtgggcctcagagccaaactatatcaagatcctagatttttcctgaactccctaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaac

SEQ ID NO: 147128 - DNA, 635 bp, Homo sapiens
  Payload ID: 9105
  Gene Symbol: KXD1
  Gene Name: KxDL motif containing 1
  ENST ID: ENST00000597438
  CDS Start-End: 135-635
ttcagaagggtgaagtggctctcccatggtcaaacagcctacctctctgcgtttcttcaataaatctacatttggagttgggatcagagctcttgctgggtcaatttcactgtgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccag

SEQ ID NO: 147129 - DNA, 1327 bp, Homo sapiens
  Payload ID: 9105
  Gene Symbol: KXD1
  Gene Name: KxDL motif containing 1
  ENST ID: ENST00000601630
  CDS Start-End: 61-648
gccatcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggcttcactgcgcacttaagtgtctgggacaattccaaccctgggataaaatcttgacgacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatattttt

SEQ ID NO: 147130 - DNA, 517 bp, Homo sapiens
  Payload ID: 9105
  Gene Symbol: KXD1
  Gene Name: KxDL motif containing 1
  ENST ID: ENST00000600099
  CDS Start-End: 1-257
gcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcagatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctg

SEQ ID NO: 147131 - DNA, 1095 bp, Homo sapiens
  Payload ID: 9105
  Gene Symbol: KXD1
  Gene Name: KxDL motif containing 1
  Uniprot ID: Q9BQD3
  ENST ID: ENST00000595073
  CDS Start-End: 49-579
gcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagttta

SEQ ID NO: 147132 - DNA, 656 bp, Homo sapiens
  Payload ID: 9105
  Gene Symbol: KXD1
  Gene Name: KxDL motif containing 1
  ENST ID: ENST00000600372
  CDS Start-End: 262-656
ggctccagggtacgtccccgccacgcgcgctcgcaggatcggtgcgtggtgacgtttcgccggcgcgggcgccatcccggaagcgcgagcaaggccgccagatgtgcaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacggg

SEQ ID NO: 147133 - DNA, 498 bp, Homo sapiens
  Payload ID: 9105
  Gene Symbol: KXD1
  Gene Name: KxDL motif containing 1
  ENST ID: ENST00000599000
  CDS Start-End: 58-444
atcccggaagcgcgagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccgtaagtgtcacgcagggttcctgctcccgagcacgtcagcactctccacccagggcaggcttctggaaggccaccttggggcctgatactgagaccaggctgtaatgggcagtgggtctggggaaacctggggtgggggc

SEQ ID NO: 147134 - DNA, 895 bp, Homo sapiens
  Payload ID: 9105
  Gene Symbol: KXD1
  Gene Name: KxDL motif containing 1
  Uniprot ID: Q9BQD3
  ENST ID: ENST00000600654
  CDS Start-End: 45-575
gagcaaggccgccagatgtgcaggcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcggaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctc

SEQ ID NO: 147135 - DNA, 2738 bp, Homo sapiens
  Payload ID: 9105
  Gene Symbol: KXD1
  Gene Name: KxDL motif containing 1
  Uniprot ID: Q9BQD3
  ENST ID: ENST00000602094
  CDS Start-End: 1461-1991
tgagtagctgggactacaggtgcccgccatcatgcctggctaatttttgtatttttagtagagacgggggtttcaccatgttcaccaggctagtcttgaactcatgacctcaggtgatccaccagccttggcttcccaaagtgctgagattacaggcatgagcacccggtccaggtatcctctttatacaagatcatgcttctttgggaatgtggagactgggtgtctctgcatggcatgtcataggagttcaataaccatagttattattagagggaagggggttttgctgggtgtggcaccttatttctagaaggtgctgcaaaccactgaccagatacagatcacaaatagatgctcttggcctccatgatatcttggaaaaaagtattgattgctgacatttgtcaatgaggcaatttcccagaaaaaaaaaatccctgtttcctttttcctggagaaacatcagaagtcaggcagaaatcagctgctgtaagaagccactgtcctgtcacagctggatattgtgcacctgttcagattcacacctttgtgagacccgtgggctgtggccgtttgttgtgacttaggttcactggctgtgtgacagtggcccagtttctcagtgtccctgagcctcagttttctcatctataaataagaatgataacagtatgtatgagcttgatgctttgtttagcatagagtagctgctgaataaatgggagagtacattaagtgagctctgaaaccctttctttctctttcctttctttctctctttctctgtctctctctctttctctcctctctctttctctctttgtctctctctctttctctccttctctctctctttctctctctcccttccttccttccctccctccctcccttccttccttcttttcgagatggagtctcactctgtcgcccgggctggagtgtagtggcatgatctcggctcattgcaacctctgcctcccaggttcaagccattctcctgcctcagccatccaagtagctgcgactacaggtgcccgccaccatgcccggctaattttttttgtatttttagtagagactgagtttcactatgttggccaggctggttttgaactcctgacctcaagcagtctgcccacctcggcctcccaaagtgctaggattacagacgtgagccaccacacccggcctctgaaaccctttctgatccagtagaagttcgtctctgtttcttggctattaaatgtgtgggcctcagagccaaactatatcaagatcctagatttttcctgaactccctaggagggtcagtgctgtagcccctcctaccctggctgctccgggaagtccctgcctgccattacggtcatctgtgtgccagcaaaactgggaacctcagaaccatctggattgctggggcccacaggttggctgcagcggaggaggagaaagagatggacctcccggactcggcctcgagggtcttctgcggccgcatcctgagcatggtgaacacagatgatgtcaacgccatcatcctggcccagaagaacatgctggaccgctttgagaagaccaatgagatgctgctcaacttcaacaacctgtccagtgcccgcctgcagcagatgagcgaacgcttcctgcaccacacgaggaccctagtagagatgaaacgggacctggacagcatcttccgccgtatcaggacgctgaaagggaaactggccaggcagcacccagaggccttcagccatatcccagaggcatccttcctggaggaagaggatgaagaccccatcccacccagcaccacgaccaccattgccacctcagaacagagcacgggctcatgtgacaccagccccgacaccgtctcgccctccctgagccccggcttcgaggacctgtcccatgtccagcctggctccccagccatcaacggccgcagccagacagatgacgaggagatgacgggcgaatagccctgctgcccggtgccttgagggggtctcagggcagcagcatacaaggtggcagcgggtaaccctgccttgttctgtcatccagggctcctttgctgccccgttctgtcacccagggctcctagggggacaaggctctctcccgaggggtgtggaattcctgggggggtctttaattctggctccttccttcctcagaacatctctattctgcaagacccctctgccatgccagggcacgcccattccagctggagtcgtggggctgggcacaggggaatttttccagagctgagcctgacgtctgctctgaagaatgcttagaaggttcccagacaccagagccagatgtcccccaccaccggtcaggacctccttgaggtgcacaagcacggtctcctctgagttcaccccagcccacccccgcacccactaattctgcttttcctgccccttgctccgtaaaagtatcaaatactttctccttggtatctcaaggaggtttctgagataggtagaagtcttgagacggaggctggccatccattcagccctgagcgtgctgagttctgtgtttctctgaatagaggtgtggaacctgaggggccagcaggcctctctgaaggcctccatggagcaaacggagccacctcgggaaagagtttaatggaatatttttgtacccgatgtttacagatgctgttgggaagttatcaataaaaagacaccattactaaaaagggaaaa

SEQ ID NO: 147136 - DNA, 341 bp, Homo sapiens
  Payload ID: 9105
  Gene Symbol: KXD1
  Gene Name: KxDL motif containing 1
  ENST ID: ENST00000596244
  CDS Start-End: 326-341
gacgggagggaggtgccaggaacccctcagccctcacatctgggagccagagacagaaaagagtcctgttttgaaggaggagtgtatcccagaaggtcccagtactgtgtctcactggtactagctatgggcctccctctccaggtgtctttttttttttttttttttttttttcagttgagatgaagtctccctctgtagcccacactagaatgcagtggcttgattttggctcattgcaacctctgcctcccgggttcaagcgattctcctgcctcagcctcctgagtagctgggactacaggcagcggaggaggagaaagagatggacctcccggact

SEQ ID NO: 147137 - DNA, 15316 bp, Homo sapiens
  Payload ID: 9106
  Gene Symbol: KYNU
  Gene Name: kynureninase
  Uniprot ID: Q16719
  ENST ID: ENST00000264170
  CDS Start-End: 259-1656
tggcatttgaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacagaaaatctgatataatttttcagagtctgtggcactaaggagtccacagggctgcctaggtgctttgtgtttgggggaccaaaactgtgttggttcaagtattatctatacagtctctataagctgtcacatttcatggtcattgaaatgttttatgttggtttaatttctgatttaactgacaacttcataatgtatgtgcaattattgtgtcaaatttagaaatattactttagcttcaatttaccaaggagtttctttgaagcattgtagtctgatatatatatatatatatatatatatatatatatatatatatatatatgtgtgtgtgtgtgtgtgtatatatatatatatatatcatatatatatgatagtggctttcaaatttttttgggtacaatccacattgctcctgctgatctgtaatatcagaaaccagtatttatgtgaatatatgagaaatattattgattctaagatattttatcatattttaacatctttgaaagaggacccatctttcaattttcgatcaatagtttcttacagtcaccattggccatctttctcgttaccatctatgaaattagcatgcatctcaaataaacagttaccatcttctatttgataaaatagtctaaatagcaaaaataaaagtttttacaattatttgcctgtgctctaataggtactattctattttatctcataagaaatgttggaaactcattatattgatttccttacccactcatgggccctaattcacactttttaagaatgtttctttctttaatgttatcataatctcttactttttaaatgagaacttcccctaatataagagcttagatattatattactatgtttccatagtaaataaataaccccaagatctttttggggattagagatataagaaatatgtgctccatctcttgacatctttatctcaaatctatggacctttcttacccactgtgaaaaacctaaagttacacttagccctgttggacttacctagttttcaattgttgatgccacaatcattatttataagttgacaaaatagtgtagatttgtatacatagtcaacaaaaagagtgacataattattgcctccaattaaacaagtttgaatgaaataaacaaacttagataaacacttcggatggtagacgtaaacaataatatgtggaactccaacatcaacacctaccaataccagtaactactgatatttatcatgtacttaccatgtaccatgtattgtgctacattactcatgttatctcccttaattgagtggctacatactgctttagcaaatcttcctactgtaactaatcctcatagatggaagagttctcaaaaccttaaaactcatgcataagtggattcatatacatatataaaaatatatataaatatatatactttatatatatttatatttatatatttatatatttatattttaatatatttatataaatatatataaagtataatatatataaagtataaatatatatatatttatactttaagttcttggatacacgtgcagaacatgcaggtttgttacataggtatacatgtgccgtggtggattgctgcacccatcaacccgtcatctacatcaggtatttctcctaatgctcaccctcctcttatccccaactacccaaaaggacctggtgtgtgatgttcccctccctgtgttcatatgttctcattgttcaactctcacttatgggtaagaacatgcagtgtttgattttctgttcctctgttagtttgctgagaatgatggtttccagcttcatccatgtccctgcaaaggacatgaactcattcttttttatggctgcatagtattccatggtatatatgtgccacattttctttatccagtctatcattgatggccatttgagttggttccaagtcttcgctattgtgaatagtgctgcaatgaacatatgtgtgcatgtgtctttatagtagaatgatttataatccttagggtatacccagtaatgggattgctgggttaaatggtatttctggttctagatcctcgaggaattgccacactgtcttccacaatggttgaactaatttatactcccaccaacagtgtaaaagcattcctatttctccacatcctctcagcatctgttgtttcttgactttttaatgattagcattctaactggcgtgagatggtatttcattgtggttttgatttgcatttctctaatgaccagtgatgatgagttttttttcatatatttgttggccgcataaatgtcttcttttgagaagtgtctgttcgtatccttcacccactttttgatggggttgtgtttttcttgtaaatttatttaagtcccttgtagattctggatattttccctttgtcagatggatagattgcaaaaattttctcccgttctgtaggttgcccgatcactctgatgatagtttcttttgctgtgtagaagctctttagtttaatcaggttccatttgtcagttttggcttttgttgcaattgcttttggtgttttagtcttaaattctttgcccatgcctatgtcctgaatggtattgcctagatattcttctagggttttttttttggctttaggtcttgcagttaagtctttaatctatcttgagttaatttttgtataagatataagaaaggggtccagtttcagttttctgcatatggctagccagttttcccaacactatttattaaatagggaatcttttccccattgcttgtttttgtcaggtttatcaaagatcagatggttgtaaatgtgtggtgttatttctgaggcctctgttttgttccattggtctatatgtctgtttttgttcagtaccatgctgttttgtttactatagccttgtagtatagtttgaagtcaggtagtgtgatgcctccagctttgttctttttgcttaggattgtcttggcaatacaggttcttttttggttccatatgaaatttaaagtagttttttctaattctgtgaagaaagacaatggtagcttgatggaaatagcattgaatctataaattactctcagcaatatggccattttcaggatattgattcttcctatctatgagcatggaatgtttttccatttgtttgtgtcctctctggtatccttgagcagtggtttgtagttctcattgaagtagtccttcacatcccttgtaagttgtattcctaggtattttattctctttgcagcaattgtgaatgggagttcactcatgatttggttctctgtttgtcctatatacatatgttggtatataggaatgcttttattttaaagatggaagatgatgtctctctatgtaactcaggcaggtctcaaactcctgggctcaaatgatcctcctaccttaacctcctgagtagctgagactttagtcacacaccaccatgcctgaccaggaattgtttttcaacttcatagtggtaaacaaaacatatgtgttttcagttctcatggaacaagcagcttagtaggagaaacatatgttgaacttgtaagcagagaagtaaatctataatgacaaatcataatttctgaagggtattaattagatgtttgagtgaggggaaatattggaaggtgctcataagtttataaatgttctaaaatatttcatgctaatcacattaaaattatatcaaagtatataaacatatcatggaaaacataatcagcaccatgtactcaacacctaggttaaaaaatagcattaaaaattctctttccagctcacattctgctccctccccaaatccacagataaccatcgaattatattttgttttcttcattcccttactttctttaagttttacacccatgtatgtacccataaaaatctattagctaattttggttgtgcatgaatattgtatcaatgcaattatactgtatatattctgcttttgcacatatttttagattcatccatttgtggcatgtagctttccattcattttcactgctgctcagtattgtattacaaattttacatttgttttagggaagagtcataaaccatctttaagttctcctatgttacaagtaattttgtaaatgatgtgaggtggtgattctatttcattttttcccatatagataatttatattattaataattccttctatttcataagccaggtttctatatatctatataaatatagatatgtagatatatgaaagcaatatatatatggatgtctttctgggctatctgtactttcacactggctaatttgcttgttttttcatcaatacttcacttccttaattactacaacatagcagggcctggcatctgctagattaaatctctcagcttctttttattaagattgccctgaattgtcctggttatcctgggccccctactttttttatatttttgaatacatctaaataaatttagaataaatctattgtgttccataaaacccctgttgggatttcaattgaactgcaattaaattttagatcagttttggaagaattgactcaatagtgagccttcctacccaagaccatggcatttattttcatttatttatgatttctttaatgcttctcaaaattttttattttctctattatggaaacgcacatttatagtttgacaaattcctaagtacttctaattttattgtcattccacattatcttttttgttgttgttttaaaagacagggtctccctctgtcacccaggctggagtgtactgatgtgattatagctcactgcagtctcaacctcctgggctcaagtgatcctcccacgtcagcctgtggagtagctaggactacaggcatgtgccacaatgcctggctcatttttaagtgttaagttaaaaaaagttgtagaaacagtgttttgctacatttcccaggctggtctcaaactcctggccccaagcaatcttcctgcctcagcttcccatattcggattatacgcatgaggcattgcaccagccccatgtgttatcttttataaaatttaacatttaactgataattgatactgtatatacatgaattcaattggtatctatttttaatatgggaaattttatgcaaatgagcacatttttctcccttccttccttccttctttccttgttctctttctttctctctctttctctttctctctttctttctttctttctttctcacagggtgtcactctgttgcccaggcggagtgcagtggcacatgatcatagctcactgcaacctccaactcaaacacttgagtgatcctctgtcccccgtttcccaagcagctgggactacaggcacatgccacgatgccaagctaatttttaaaaataattttttttgtagattcagagtcttgctatgttgcccaggctaatctcaaactcctggcctcaagcagtcctccctcctcagcctcccattacaggcataagctgccactcctggacctcttttttttttttttttttttttttttgaggcagtctctctctgtcacccaggctggagtatagtggcacgatctcagctcactgcgggttcaagcaattttcatgcctcagcctcccaagtagctgggattacaggcatgggccactatgcccagctaatttttgtatttttcatagagacaggatttcaccatgttggctaggctggtatcaaactcctgacttcaggtgatccgcccactttgaccttccaaaatgctgggattacgtgtgagccaccaaacccagcccctcattttctttttgatttttatttattttcctctgtttttcttcttttggatttagggatgtgtgtgtggaggtgtattgagtccgttttttctttctatttgtgtggaaattatacacttattctttgttattttagcaattactctggctattttaacatgcaaatataatgaagtttagaattagccattttttataactctccttctgactagttgaagaaatgagaatgctttaacatcaaacagccaactctttacttatacactattgctattcattatagcatttttagtctagcttcctccctcctctttctctctctctctctctgtctctctctctctcactaatgtttgctatttctccctacaattcagaattttatttatggatgaagtacatatataatttattacaattcattttaatgaaaaacttttagtggtaaattgtattagtctttgggaaaaaacatttattgataccattttctcattacttaaaaatagtttcacttcatatagaattctatgtcgacagtaattttctttcaggaagtagaaaatattaagttacagtattttggcttccattactgctgttaagcattcagatcatcagagaaatgcaaatcagaaccacaatgagatgccatctcatgccagtcagaatggcaatcattaaaaagtcaggaaacaatagatgctggtgaggctgtggagaaataagaatgcttttacactgttagtgggaatgtaaattagttcaaccattgctcttaagggctctttgtctttaatgatccgcatttttattatgatgtgtctaggcagttattattgtgtttattctatttctttatttgctgtctatccaagatttgaggattaattttttaatttctagaaaattcagaagtattatttatttattcaattattacctctttctattatttcctttttaaaataaaagggtatatgttagaatttttcactctctcctttatgcctttaacttcatattttctatttctttgaatttctgggctgcattcttaagaattctaaaacatatattttagtttctaaaagtttcattagatttctgttcaaaattccttccatttgtgatctttcgaatgtgcttctgctttaggcattagtagtggacattctggttccccattgagcttccctgcatcagctgttttgcctggtggctgccaccaacgcttttagctacctccctcctcaaactttggggtcaggccacacactataaaggattggaaaaaaaaatgaaaatatgaaaaacttacactttgtatcagtcaggagaaggataatcttcacactacagtttatgcttcagaagccaccccttctctgtggattagaccatgactagaagtttcctgagaccatcccttgcccagctcttttggtgatccccttcacttcctctgttacaggtttccctgatgagcactccttcaataaaacatagtcatccaaatcccaatctcaagcacggtgtcacgggaacctgatctaagtcagcattttctttattcttaatcacaactagttgatagtccatatctaatatataatgaatgtacagttgtttctgttggagttcacatatgatgccttgtttcctttgtagttttgtgattgatagcttcgaactgctcatttaccttgaccttttgaattctttgaaaactgagttaagtctgattttccagagtttttatgtttgcttctgtcagttgcagagaatcaatgagaagaacactttaaattcttgttttcggtttttttccaatcacataagtaggatttacctgaatatatatataatatataaacatatatttatataaaataaaaacatataaaatatgaaatatataatacagtataaaatctattttatgtaaaatctattttatgtaaacatgataattaaatatatatttaaataatataaatataataaatatttgaagcaattgtattttttaaaaatttcttctaaagaaaaccaggatacatgtgcagaacctgcaggtttgttacataggtatacgtgtgccatggtggtttgctgcacctattgacccgtcctctaagttccctcccctcacctcccaccccccagcaggccctggtgtgtgttgttcccctctctgtgtccatgtattctcgcctcccacttatgagtgagaacacgcgatgtttggttttctgttcctgtgttaatttgctgaggatgatagcttccagcttcatccacgtccctgcaaaggacatgatctcattcctcaatactatggctacgtagtattccatggtgtatatataccacattttcttcatccagtcatgcaaatttatatgaatgtcaattcttttatagtgatcttctggggctattacaatatatagggctgtttttttaaaactaattatatttatttcatgttgctttaacttattaaaaaacagactgaagaaagactgggtgtgaagtcagtaaattaatttcaaattaaataaacttttctacagctattttatgctcaataactttctacttattcttgagttcaaaactatatgggttcacatttaaattatatagtgtattttctccataaactgaagttgttagaacattgatttttttaagtaaatggatttttgcaccacttcaagaaagaaaccttcaaacagcctggaaatatcacatcaataaagcacaacctgggaatcaaagtattagggtaccttgttactgagattatggatgtgatgcttctgtgggccattagcatgtgcactgtgtgtatgatatgctctatgttctcttcccactaataattttatttttaatttcagcaagatttagtctcaaataacacaataataatggaggtcattgtgaagtagtggatgtaaatagatctgatgtggttttggtttattgcagtaattgttttgactaattctctagtttttcaacttttgattgtttaagatggttcttgagtccttttgacatgaccctatctatttttgataacttcatagcctttagtataaaaacaggtaggcttatattacatatttccaacttcaaacttgttatttatttatctaagactatacagttcttttcagagaaaaaccttctttataaaccagaatcttaacaggaagagtgctcattttaattgagctgatcatgtttctaggattttttagttaaaagaaaatacatattttaaaaatataaattatatttttatttcatagtggtattttcaattttgtctgggataataagatgttttatttaacttgtttgattttgtagttttatctttgtgggaaggacctggtaagaggtaattgaatcatgggggcaggactttcccatgatgttctcatgataatgaataagtttcatgagatctgttggtttcataatgtggagtttccctgcaaaggctcttgtcctgtctgtgccatttgagacatgcctttcaacttctgccctgattgtgaggcctcccccgccatgtggaattgggtcttacttttgtaaattgcccagtctcaggtatgtctttatcagcagcctgaaaactgactaatatagtaagttggcaccagtagagaggggcactgctgaaaaggtacccgaatatgtggaagcaactttaaactgggtaacaggcagaggttggaatggtttggagggctcataagaagacaggaaagtgtgggaaatttggaactccctagagacttgttgaatggctttaaccaaaatgctgataataatatgaacaatgaagtccaggctgaggtggtctcagacaaagataaggaacttcttgggaactggagcaaaggtgactcttgttatgttttagacataaagcaaagagactggaggcattttgcccctgccctagagatttgtgggacattaaacttgagacagattatttagggtatctggaggaagaaatttttatgcagcaaagcattcaagaggtgacttggttgctattaaaggcattcagttttaaaagggaaatacagcataaaagttcagaaaattttcagcctgacaatgcagtagaaaaggaaaaccaattttctgaggagaaatttaagctggctgcagacatttacataagtaacaagaagctgaatgttaatcactaagacaatgaggaaaatgtctccagggcatgtcagagacctttgtggcagcccctcccatcacagaccaggagctttagaaggaaaaatggcttcgtgggctggtcacagggtccctctgctgtgtgcagtctagggacttggtgccctgtgtcccagcagctccatccatgactaaaaggggccaaggtacagcttgggctgtggcttcagagggtggaagccccaagtcttggcagcttccatatggtgttgagcctgggttcacagaagtcaagaactgaggtttgggaacttacaccaagatttcagaggatgtatggaaatgcctggatgcccaggcagaagtttgctgcaggggcaaggccctcatggagaacctctgctagggcagtgaagaagggaaaagtatggtgggagcccccatacagagtccctactgaggcaccacctagtggagctttgagaagagggccactgtcctccagaactcaggatggtaaatccaccacgcacctggaaaagctgcagacaattccagcctgttaaagcagccaggagggggctataccctgcaaagccacaggggcggacctgctcaaggctgtgggagaccacctcttgcatcagtgtgacctggatgtgagacatggagtcaaaggagatcattttggagctttaagatttgactgccccactggatttcagactttcatggggcctgtagccccttcgttttggccaatgcctcccatttggagtggctgtatttacccaatgcctgtatccccattgtatctaggaagtaactaacttgcttttgattttacaggcccataggtggaagggcgatgtttctttctggaggctccagggagaactctgttttcttaccttttctggattctagaggcttcccacaatccttggcttaaggtccatctttaagctttgtctctgatgagactttggactgcggacttttgagttaatgctgaaatgagttaagactttgggtgactgttgcgaagacatgattggttttgaaatgtgagaacatttaagaggggccaggggcagaatgatatggtttgactttgtccgcagtcaaatctcatcttgaatttctatgtgtttggagaggtacccggtgggaggtaattgaatcatgagggcaggtcttttctgtgctgttctcatgatggtgagtaagtctcatgagatctgatggttttataaaggggagtttccctgcccaagttcttctcttgtctgccatcatgtgcgatgtgcctttcacctctgccatgattatgaggcctccctggccatgtggaactgtgagtccattaaacctctttcttttgtaaattgcccaatcttgggaatgtctttatcagcagtgggaaaacggattaatatactaatttatagctagtaggtaaaaagccagggacttgccattagcgttggaagtggggttgtgggggcagtcttgtggaactgagcccttaacctgtggggttgaatgatatctccaggtatatcatgtcagaattgaattcaattagaggatacctagcttgcgttcaatgcagaattgcttgctggtgaggagaaatccctatacacattttggtgaccagaggtaaagcattttatgttgattcttgagtgagagagtagaaataacactggttttttccctatgtccttacaaccaccaattggatacattgtttcagtattttgaaatttttcatttaatttttataaattttctttttaaattttagattctacaatatctccaattcttcagtttattccctcttactatgtataagtatttccccaagtttcactttatctttctattactttttttacataatagagctataaaggcaattcacaattctctcttttctcatatataatatagagcatattataaatactctactttggaaaattattctttataggaaattacagataatatttgatgaagaaaatcgaatataatcatttttcaatacttaggataacagattcaggcaaagataaaacattaaaggaaaagttagtgaaaactattaatatatagtggaggcatcacgttgttatgaacttcattgatcaatactgataccactaaaaatggaacaacatgtaattatgtgctcaatgtgatgaatatgaagtagactgcaccactctgcagtacagtcaggaaataagaaaccaagtccaatcaaaatagccctaaagctaccttccagtttataaaaagtatgaagaatagaggggcaattaaatgataccataaagagtcaaatacagggcatgcaacatagctgctgattggatttattcaacatgtcagtggcatgaatacaataggaggcaggtagggagaaggcactaccctgaattatgagactgaagagatataataaacaaatgcaatgtgtggacttggttgggatcttcattcaaagaccaactataaaaagacattgttgtgagaattgaggaaatttgaatgagaaatgtatttttatctaatttgttagctgtgataatagtattgtgggagtaagaagctattcatatttctatatatatataccaagtacataggagtgaaataatacaaaatctggaatttgccttaaaattcctctgcaaaattataaaaaagaacgatgacaaactaaaaaggtgtagtattcttctatggctgctataacaaatgaccaaaaaacatagtgactgaaaataacccacatttattatcttacagttccataggttagaagttcaacatgggtctcatgagatcaaaagcaaggccttggcagggtgacgtttctttctggaggttccagggggaactctgttttcttactttttttagattctagaggcttcccacaatccttggcttaaggtccatctttaaagacagcaacgtttcatctctctacctattctttcatccttacatctttctctaactattccttttcttctgtcttccacttttaagagcctttttgagtctattgaggccaactggacaatcaaggattatctccctatgttaaggtcaattgattagtgacctaattccatctacaatcacaattcctctttgccatataatgtaaaatattcatacctctaaggattaggacatggacatctttgagggtcattagtcatcttaccacaggaaggaaggaaggaaggaaggaaggaaggaaggaaggaaggaaggaaggaaagggaggagaggagaggagaggtaggagggaagaagaaaaaaatagtatgaaaaaatcttgataaatttgaaaactgggtgaataatatgtggaattctctctatttttgttaatgttggaaaatttaataaaaacaatgaacagtg

SEQ ID NO: 147138 - DNA, 1772 bp, Homo sapiens
  Payload ID: 9106
  Gene Symbol: KYNU
  Gene Name: kynureninase
  Uniprot ID: Q16719
  ENST ID: ENST00000375773
  CDS Start-End: 100-1023
ggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattaggaatggaatgcaacagatttggacaagtcaaggacaagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtattttgaagtatatatgtttgaattatgtgttcttctttttgacaatttgactatatgttgatagtgcaataattgtgcagtttaagccttcaataaagaggtagaatgtgatgaaaattggaaggaaacctgagggggcattcttagtgcttggttaaacagaaagcttaacagttcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaa

SEQ ID NO: 147139 - DNA, 1576 bp, Homo sapiens
  Payload ID: 9106
  Gene Symbol: KYNU
  Gene Name: kynureninase
  Uniprot ID: Q16719
  ENST ID: ENST00000409512
  CDS Start-End: 179-1576
acattttcaaggaattcttgagaggttcttggagagattctgggagccaaacactccattgggatcctagctggaatataaagaatggcttatcagtggagaccatcgacagttgagaaaagaagaagcccaaaaagtacaagaatgaaaatcgagagtttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 147140 - DNA, 776 bp, Homo sapiens
  Payload ID: 9106
  Gene Symbol: KYNU
  Gene Name: kynureninase
  ENST ID: ENST00000410015
  CDS Start-End: 91-537
attttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaa

SEQ ID NO: 147141 - DNA, 636 bp, Homo sapiens
  Payload ID: 9106
  Gene Symbol: KYNU
  Gene Name: kynureninase
  ENST ID: ENST00000424385
  CDS Start-End: 277-507
agaggttcttggagagattctgggagccaaacactccattgggatcctagctgcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagagcagcctatggtcatgaagtggggaagcgtccttggattacaggagatgagagtattgtaggccttatgaaggacattgtaggtctaattgccttgaagaaacatcataaggactcaaaacatggaaggagccaatgagaaagaaatagccctaatgaatgctttgactgtaaatttacatcttctaatg

SEQ ID NO: 147142 - DNA, 671 bp, Homo sapiens
  Payload ID: 9106
  Gene Symbol: KYNU
  Gene Name: kynureninase
  ENST ID: ENST00000612147
  CDS Start-End: 1-505
aaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaa

SEQ ID NO: 147143 - DNA, 662 bp, Homo sapiens
  Payload ID: 9106
  Gene Symbol: KYNU
  Gene Name: kynureninase
  ENST ID: ENST00000613664
  CDS Start-End: 1-472
agcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaa

SEQ ID NO: 147144 - DNA, 802 bp, Homo sapiens
  Payload ID: 9106
  Gene Symbol: KYNU
  Gene Name: kynureninase
  ENST ID: ENST00000621320
  CDS Start-End: 1-711
gctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtggtatagaaattgattttgaaggagagagaaaatacaagatttcaagtggtcatcaaagaagaaaactaattaataaaaagaacaattgataatatga

SEQ ID NO: 147145 - DNA, 609 bp, Homo sapiens
  Payload ID: 9107
  Gene Symbol: KMO
  Gene Name: kynurenine 3-monooxygenase (kynurenine 3-hydroxylase)
  ENST ID: ENST00000366555
  CDS Start-End: 1-547
aggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggctgctgagtcactcagaaatccttcaaacatgattaattatgaagatgaaacactagagtcatataagaaataaaaattgggcaataaaataaaa

SEQ ID NO: 147146 - DNA, 4888 bp, Homo sapiens
  Payload ID: 9107
  Gene Symbol: KMO
  Gene Name: kynurenine 3-monooxygenase (kynurenine 3-hydroxylase)
  Uniprot ID: O15229
  ENST ID: ENST00000366557
  CDS Start-End: 41-1399
gacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagaggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagcta

SEQ ID NO: 147147 - DNA, 1868 bp, Homo sapiens
  Payload ID: 9107
  Gene Symbol: KMO
  Gene Name: kynurenine 3-monooxygenase (kynurenine 3-hydroxylase)
  Uniprot ID: O15229
  ENST ID: ENST00000366558
  CDS Start-End: 312-1733
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagta

SEQ ID NO: 147148 - DNA, 5261 bp, Homo sapiens
  Payload ID: 9107
  Gene Symbol: KMO
  Gene Name: kynurenine 3-monooxygenase (kynurenine 3-hydroxylase)
  Uniprot ID: O15229
  ENST ID: ENST00000366559
  CDS Start-End: 312-1772
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagcta

SEQ ID NO: 147149 - DNA, 2345 bp, Homo sapiens
  Payload ID: 9108
  Gene Symbol: KY
  Gene Name: kyphoscoliosis peptidase
  Uniprot ID: Q8NBH2
  ENST ID: ENST00000423778
  CDS Start-End: 63-2048
atttgcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgaaaacttggtggagaagcagcaccctcagcagccccaggtcatcacttcctacaacagccaagggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacgcctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttcctctacaatgagttctacttcctcacccaccctgcactgttcatcgaggaccacttcccagacaacaagaactggcagctgctaaaacctcctcaatctctgaggcagtttgagaacaacatgtatcacaagagtgaattctacaacaaagggatgctgagtgcccacccagagacttccatgatcagaacagtgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggcactcacaagctgcagatctttgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaagatctttgtcaagaagaggcaggaaccaggaaactacatcttcgtctttaattaccttgtatgctgtgccaacaccaaggtgaactggcccatgttccctgagagctttggcaactggggacaggacaatgagctgctggaacctctgtcaggtgtgcttcctgccaaccggaatgtcccattcaaattgaagctgcatggtattgccaaagtcctggtgaaggggcaggacacatggcccctgaccctgaaccacgagggctactgggagggaagctgcagcacagctggctgccaggaagtctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccacaggagctgtgatctttgtgttctgaaggcttcactcaggtgtggctgtgactgagggggcagaggcagtggctctttagaaggaaaaggtgctatgtaaatctaaggtattgtaaactgtacacctgcatccagatgccccttctcgtatt

SEQ ID NO: 147150 - DNA, 2422 bp, Homo sapiens
  Payload ID: 9108
  Gene Symbol: KY
  Gene Name: kyphoscoliosis peptidase
  Uniprot ID: Q8NBH2
  ENST ID: ENST00000508956
  CDS Start-End: 59-1981
gcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacgcctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttcctctacaatgagttctacttcctcacccaccctgcactgttcatcgaggaccacttcccagacaacaagaactggcagctgctaaaacctcctcaatctctgaggcagtttgagaacaacatgtatcacaagagtgaattctacaacaaagggatgctgagtgcccacccagagacttccatgatcagaacagtgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggcactcacaagctgcagatctttgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaagatctttgtcaagaagaggcaggaaccaggaaactacatcttcgtctttaattaccttgtatgctgtgccaacaccaaggtgaactggcccatgttccctgagagctttggcaactggggacaggacaatgagctgctggaacctctgtcaggtgtgcttcctgccaaccggaatgtcccattcaaattgaagctgcatggtattgccaaagtcctggtgaaggggcaggacacatggcccctgaccctgaaccacgagggctactgggagggaagctgcagcacagctggctgccaggaagtctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccacaggagctgtgatctttgtgttctgaaggcttcactcaggtgtggctgtgactgagggggcagaggcagtggctctttagaaggaaaaggtgctatgtaaatctaaggtattgtaaactgtacacctgcatccagatgccccttctcgtattagtgctgctgctgttgttgttgctgtagggttgatgagggaaagcagggatattgcccaggttgacagcttttcacatgatgcttagagaattctcttccatgcccaaggggacatgatttgcaaggctgggttgtccttgaat

SEQ ID NO: 147151 - DNA, 2003 bp, Homo sapiens
  Payload ID: 9108
  Gene Symbol: KY
  Gene Name: kyphoscoliosis peptidase
  ENST ID: ENST00000503669
  CDS Start-End: 62-988
tttgcagcgcaagcagcctagcgtgcggccgcggcgcccaggtcggaaaggaggcggcatcatggagctgaagaaggacatcaacgctgtatctatcgacatgctgctgatcgtgcactcggagaagcggcgcgccgcacagggtacgctctcagaccagcaggcgaacccgagctcgctgctgcagcgcggaggaggattccaaggtgttggaaatggagtccgaagatggcagaaattagaaggaaatgactttcacgaaaacttggtggagaagcagcaccctcagcagccccaggtcatcacttcctacaacagccaagggacacaactgactgtggaagtccaccctcgagatgccatgccccagctgctcaagaagttctccttggctaaacgtttacaaggtgataaaaatggaaacacaagaccccggcaacctggagggaaagatgcccatgcctacccctgggatcgatctagcctgaaatccatgtccctggacctgcagcagtttgagaaattggatatctacgcctcacaggtgacagccaagagtggcctagacgaactggtgagtgacctgctccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggctcgccggagtgcagtgtatgaccgtgcctggctactccaagggtttcggctaccagacagggcagagcttctcgggggagtttgaccatgcctggaatgctgtgtacctggagggaagatggcacctggtggacagcacctggggcagcggcctggtggacaccatcacctccaaattcaccttccttgaatgggaaggccacggtcaccattgagagctgcgccccgacgctgttcatgttcatgctcaatggcaagcaagagcatgggctgctgagcctaaggaagaatgggatgaagttggaggtgtaccctccaaccatgggcactcacaagctgcagatctttgccaagggcaactccgacatctacagctcagtgctggagtacacgctcaagtgcaattatgtggacatgggtgtccagctgcctgctgagcttcaccagcccgtgggccccagctggttctcggagcagatgggcatcatgaagccctcccaccctgaccctatcatccacaccagcgacgggcgctgctccatcagcttcagcgtggaggagggcattaatgtcctggcttccctccacggggatgatggccccatcactgaggagacacagcggcgctacatcttccagctgcaccgggagaagcagaccgagctgaaagtccagctgccccatgcaggcaagtttgccctcaagatctttgtcaagaagaggcaggaaccaggaaactacatcttcgtctttaattaccttgtatgctgtgccaacaccaaggtgaactggcccatgttccctgagagctttggcaactggggacaggacaatgagctgctggaacctctgtcaggtgtgcttcctgccaaccggaatgtcccattcaaattgaagctgcatggtattgccaaagtcctggtgaaggggcaggacacatggcccctgaccctgaaccacgagggctactgggagggaagctgcagcacagctggctgccaggaagtctatgtcatggtgctggagaatgccaaccacaatttctactcctacatcctgaaatacaaagtgaatgcccagtgagggctgtgccccggtcttaccctcccaaagggccaaggccagacctccccagggagggctcgaaggaagtgcagggagccctggacaccactgagtctgcatgaaatcccttctaggcctctgcctcagtgtcccacctctgccaca

SEQ ID NO: 147152 - DNA, 949 bp, Homo sapiens
  Payload ID: 9109
  Gene Symbol: LAGE3
  Gene Name: L antigen family, member 3
  Uniprot ID: Q14657
  ENST ID: ENST00000357360
  CDS Start-End: 343-774
ggcgaccacggtgtcttcaaaagccccgtcagggttggcttcctggggccggaccgactgtgggtcagtttgcaccagcgctctggaatcgagttacgcgcgaaagggcagagtttctggaggaaaccgcagcctctcaaccgctgaccgggtctcagaaggcccccggcagggccgcttggcgggaactgaccacgcgccagtcaggctctccagggacctgcgcaggcgcgtgtgggcggagtcgtgcgcagggggcggggcttcgggaaggagccacagagagggcggggcgtaggacctgcgcttcgggggtggagtcggagcggcgcggcggcggtcatgcgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggccagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactattccaa

SEQ ID NO: 147153 - DNA, 599 bp, Homo sapiens
  Payload ID: 9109
  Gene Symbol: LAGE3
  Gene Name: L antigen family, member 3
  ENST ID: ENST00000621786
  CDS Start-End: 11-328
cgggacgcggatgcagacgcaggcggaggcgctgacggcggggatggccggggtggccacagctgccgcgggggcgtggacacagccgcagctccggccggtggagctcccccagcgcacgcgccaggtccgggcagagacgccgcgtctgcggcagggggtcacgaatgcggccgcacatattcaccctcagcgtgcctttcccgacccccttggaggcggaaatcgcccatgggtccctggcaccagatgccgagccccaccaaagggtggttgggaaggatctcacagtgagtggcaggatcctggtcgtccgctggaaagctgaagactgtcgcctgctccgaatttccgtcatcaactttcttgaccagctttccctggtggtgcggaccatgcagcgctttgggccccccgtttcccgctaagcctggcctgggcaaatggagcgaggtcccactttgcgtctccttgtaggcagtgcgtccatccttccctagggcaggaattcccacagttgctactttcctgggagggcctcatgttttatctggttcttaaatgtttgttactacagaaaataaaactgcgctactatt

SEQ ID NO: 147154 - DNA, 2532 bp, Homo sapiens
  Payload ID: 9110
  Gene Symbol: L3MBTL1
  Gene Name: l(3)mbt-like 1 (Drosophila)
  ENST ID: ENST00000373134
  CDS Start-End: 20-2251
gctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccgtctcttcttccccaggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgaca

SEQ ID NO: 147155 - DNA, 3218 bp, Homo sapiens
  Payload ID: 9110
  Gene Symbol: L3MBTL1
  Gene Name: l(3)mbt-like 1 (Drosophila)
  Uniprot ID: Q9Y468
  ENST ID: ENST00000373135
  CDS Start-End: 133-2451
agagtggggcaccctgggactggaccccgcaggtgcttgggggcgtagcctggagtgagggtttggctggtgtagcttggagtgaggccccctggcgtggagtcttgaggcctgctgagggcgtgagctggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgactttta

SEQ ID NO: 147156 - DNA, 460 bp, Homo sapiens
  Payload ID: 9110
  Gene Symbol: L3MBTL1
  Gene Name: l(3)mbt-like 1 (Drosophila)
  ENST ID: ENST00000439769
  CDS Start-End: 47-460
gctaggcgctgggcggccaccggctggccaggcaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggc

SEQ ID NO: 147157 - DNA, 3365 bp, Homo sapiens
  Payload ID: 9110
  Gene Symbol: L3MBTL1
  Gene Name: l(3)mbt-like 1 (Drosophila)
  Uniprot ID: Q9Y468
  ENST ID: ENST00000418998
  CDS Start-End: 77-2599
gcaggcgcgcggcgcccggctcggaccgtagctaggcgctgggcggccaccggctggccaggcaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatgaaataccaaatgtcacagcattattactgaatgtcagtcatttcccctacttgatctgcaatgccaatatcaagggccatgtatcaggtttctgtatatgttccactataatcttatgggaccatggttttaaatgtggaatcattgacagaaatgtctttatgtagcatatggctgtgtatcactagtatataatagagcaatattatggaggaatatgtagatccaatcactttacctatacaaaatgactgctatggtgggaacacaataaacaccagttttgactttt

SEQ ID NO: 147158 - DNA, 3157 bp, Homo sapiens
  Payload ID: 9110
  Gene Symbol: L3MBTL1
  Gene Name: l(3)mbt-like 1 (Drosophila)
  Uniprot ID: Q9Y468
  ENST ID: ENST00000427442
  CDS Start-End: 160-2682
gcaggcgcgcggcgcccggctcggaccgtagctaggcgctgggcggccaccggctggccaggcaggcctgccaggatggaggggcatgctgggatggaggggcatgctgaaatggagatgctgaggacactgaaggggccttccacaggggaggtcagcatgcacttggtggccggagacagccccggttctggtcctcacctgcccgcaactgccttcatcattccagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgacacagatattgtgatttactgcaaggatcctaacacacacttaaaatcaagagccaaggagtagtgagttgtagataaaaaaagaatgtcagctttggagacagtctgggtttaaatcccagttctgtcaatttgagctgtttactgtctctgagcctacatcttcttgtctgtaaaatggagataaaatgggtttaatgaggtctaccttgcagagccattgtgagcattggaaatgatgaatgaatcataccagaacgtctagtataattacagtcatgcattgcttaacgatggggatacattcttagaaatgtgtcactaggcaattctgtcattgtgtaaacattatagaatgtacttacacaaacctagatgttatatgtatttttatttacatgtatattttcacatga

SEQ ID NO: 147159 - DNA, 4322 bp, Homo sapiens
  Payload ID: 9110
  Gene Symbol: L3MBTL1
  Gene Name: l(3)mbt-like 1 (Drosophila)
  ENST ID: ENST00000422861
  CDS Start-End: 1-1617
cagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcctcccaaaggttacaaggaggaggagttcagctggagccagtacctgcgcagcacaagagctcaggctgcccccaagcacctgtttgtgagccagagccacagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgagatgattgacggcgaggccttccttttgctgacacaggcggacattgtgaagatcatgagcgtcaagctgggcccagccttgaagatctataacgccattctcatgttcaaaaacgctgatgacaccttaaagtgactggcccagggctgggccctcctgcagcccctgcttggcctccctctccagctgatgctttcttcctgacctgaattcctcataccccacacgtccccatgctccacctatatctgaccaggctggtccttcttagagggtgcatgggagctgaggagccctggggagggtaggcacccagccccaagtcctagagctcattcgtcaccaggcatgttggtgagggcgtgactggcaggggcattactcatggagtcagttggactgtggcagcccccacagccccagtggacttttattgtattaccaaagggtctttttcttggcagtggaggagagactagtagagcagcagtccttcaatctgaggcccctttcccttttttggtatctctgtgtacttttctctccttggctcctttcctcctgccaagaagtgaccccaccacaaatgtatttactcctggaggtacctcctctctttctgtctgctggttttgctgccctcattctgctgcttcgtttcctgggcagtgcccccagccagaccccactggctcttccccctgagatatgtgaacctcggaaacatgttttcctaagatcccttggaagtctctagctgcctttctctcttttgcccagaattgagagattttgagccaagatgccttcctgaacttacccagttctggaccagttggcattttagtgtcccacgccaagtccaagtttcagcagaatgagcaggtggtttgagcctgttttatagatggcagaggttgaggttccactgctgttttccatacacccttcatgtgttgagtctgggaaggagtaagcctagcctgccagtagcctaggttaggagaccagcataaggatttgttagacaatctcgggtctttggccagaggggcagctccagcaggcatagtggtgcctgaagttaggaatactgtactctctgtagctttggacctcagccaaggtattgcccatggggtgatggctccaggcctgccaggccttctgccatgagaatgtagcactctgtgtagcacacacccccatgacatcatttaacctgtcccttaaatgttgaccattagctcttgcagcgtcttacaaagacgacttgaagttgggagttaggaaggtgaacttttctatctgaattctccgggtccctgaagccctccttgccgctctccatctgtcttgcactgccagctgggtccctgctggggctctgggacttccacttctcagtccacataggaacccagcttccactgagtcactgccaaacctgcctcccagcctgggtgggaagggggagagccactggtaggagccagccccacatggaggtgaggagccactgccaacctcccgtgtccaggtgctgatgtgggcctgcggagtgtggggctggtgccttcacccagaccccttcaatcatgtgatgtgtgtgtgtgtgcatgtgtgtgtgtgtgtgtgtgtgtggcactctcagaagtgtttgacagggtgcagatgtgaggcttagtgttgggaaaatgccaagggctattatcattaaaatttgaagctttatttttcccttagaagtgggaaacccagagctctgttgatttcctaccacaacccagtaggggcctctctctgccatgggctggacagctttttgaggaagccattcagctcccacagttgagctcccacagggctttaggtgtccattccctctcaactgcttagaggcagctttgagcacagccttcctggaaggaagctaggcaagacctgccacacagcgaaggttgggtttacaagggtgacattggtacccccttggccaagagtaaagaagaacaagtctaagccttgcttttatcttagttgtctgggtggtagcagaactcatcagctccttatcctcagtctgttcctctataaaagatgagagatgttcactgactttgtgcagtgagaaggcagcaagtactcacggctggtgctgtgggacctcacagcttctaaggagaggggctgggagggcctttgccatcagatctgccaagcacctaatgcttgcctgtggtgaaggcaagatggaccaagggccttggagaaaagggctcccaggcttctgaactttgaggcctcagcactttctgcattatcgtcaaactctttggaaagaaaccaaatcattaaaaagtagaaagaaatctgcctcttgtctgccctactgcccctttacccccactctgtccccaaatgatattattgcaccttgacctgggagcgcagagaggggagggagttggcagagacttctggtgccctctgccctcctagcaacagatgccacttatattttggcccctggcagcctcgcccagcccctgatcagcccaggcctagggcagttaggacctttctgtttattttctgaagcagagagaatgatctcagagtttgcaaatgaagccttttttgcactttcattcacatgcactttggtggggttacatttttgtacttgcctcttgtgtgtgcacatgtgtgtatgtgttctttaagagaatcttctggcttaagctaaggtgactcttgaaggagaaaaagttacaaacaaaatgtggtgtgatctgtcagtgtatcaaaacaacataaataaacttgaacaactgata

SEQ ID NO: 147160 - DNA, 865 bp, Homo sapiens
  Payload ID: 9110
  Gene Symbol: L3MBTL1
  Gene Name: l(3)mbt-like 1 (Drosophila)
  ENST ID: ENST00000445228
  CDS Start-End: 1-136
tgacttctgggtcaatgccaactcccctgacattcaccctgctggctggttcgagaagacgggccacaagctgcagcctcccaaagagtcccccacccctgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgaccacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgactcggaggcctc

SEQ ID NO: 147161 - DNA, 573 bp, Homo sapiens
  Payload ID: 9110
  Gene Symbol: L3MBTL1
  Gene Name: l(3)mbt-like 1 (Drosophila)
  ENST ID: ENST00000434666
  CDS Start-End: 320-573
gcaggcgcgcggcgcccggctcggaccgtagctaggcgctgggcggccaccggctggccaggcagccagttcggccaccctcggcctgcccagcagtgccctggatgtgtcttgctttccccgggagccaatccatgtgggtgccccggagcaagtggccggctgcgaaccagtttctgccaccgtcctgccgcagcttagcgccgggccggccagctccagcaccagcacagtgcggcttctggaatggacagaggccgcggccccgcccccagggggcggcctgcggttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgtt

SEQ ID NO: 147162 - DNA, 3296 bp, Homo sapiens
  Payload ID: 9111
  Gene Symbol: L3MBTL2
  Gene Name: l(3)mbt-like 2 (Drosophila)
  Uniprot ID: Q969R5
  ENST ID: ENST00000216237
  CDS Start-End: 159-2276
gaatggcgggagcaggcacggaaccggcttttcctccttcctgcagcgtgattggcccgcggctcagggaggcgaccaatgagtgctctcgcggagagcgacggggcaggccaatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 147163 - DNA, 864 bp, Homo sapiens
  Payload ID: 9111
  Gene Symbol: L3MBTL2
  Gene Name: l(3)mbt-like 2 (Drosophila)
  ENST ID: ENST00000449635
  CDS Start-End: 1-864
gagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaaggtcggcagtgagcccttaactgatgtgcctccttccgctcttccatttttctgcatcctgcatgccactcactggagcat

SEQ ID NO: 147164 - DNA, 946 bp, Homo sapiens
  Payload ID: 9111
  Gene Symbol: L3MBTL2
  Gene Name: l(3)mbt-like 2 (Drosophila)
  ENST ID: ENST00000450939
  CDS Start-End: 1-699
gagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtga

SEQ ID NO: 147165 - DNA, 531 bp, Homo sapiens
  Payload ID: 9111
  Gene Symbol: L3MBTL2
  Gene Name: l(3)mbt-like 2 (Drosophila)
  ENST ID: ENST00000453659
  CDS Start-End: 52-174
aggccaatatggcttcctgcacctggtgacgcttggcgaaactgaggtctcatggagaagccccggagtattgagagatggggtgtggctgtgttgccaaggctggtctcaaactcctgggttcaagcaatccacctgcctcagcctcccaaagtgctgggattacagatgtgaaccaccgtacccaggctcttcacacgttttctgttacatgctgggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccaggtgccttcagagtgtcccctgaggatggagaggagatagaagattatagaggaagaggggggtggatataggcta

SEQ ID NO: 147166 - DNA, 3282 bp, Homo sapiens
  Payload ID: 9111
  Gene Symbol: L3MBTL2
  Gene Name: l(3)mbt-like 2 (Drosophila)
  Uniprot ID: Q969R5
  ENST ID: ENST00000452106
  CDS Start-End: 40-1884
cttcctgcacctggtgacgcttggcgaaactgaggtctcatggagaagccccggagtattgaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccagctgtctgtgagatgtgtggtatcgtgggtacaagggaagccttcttctccaagaccaagaggttctgcagcgtctcctgctccaggagctactcctccaactccaagaaagccagtatcttggctaggttacagggaaaaccaccgaccaaaaaagccaaagtcctgcacaaggctgcctggtctgccaaaattggagccttcctccactctcaagggacaggacagctggcagatgggacaccaacaggacaagacgctctggtcttgggcttcgactgggggaagttcctgaaggatcacagttacaaggctgctcccgtcagctgtttcaagcacgtcccactctatgaccagtgggaggatgtgatgaaagggatgaaggtggaggtgctcaacagtgatgctgtgctccccagccgggtgtactggatcgcctctgtcatccagacagcagggtatcgggtgctgcttcggtatgaaggctttgaaaatgacgccagccatgacttctggtgcaacctgggaacagtggatgtccaccccattggctggtgtgccatcaacagcaagatcctagtgcccccacggaccatccatgccaagttcaccgactggaagggctacctcatgaaacggctggtgggctccaggacgcttcccgtggatttccacatcaagatggtggagagcatgaagtacccctttaggcagggcatgcggctggaagtggtggacaagtcccaggtgtcacgcactcgcatggctgtggtggacacagtaatcgggggtcgcctacggctcctctacgaggatggtgacagtgacgacgacttctggtgccacatgtggagccccctgatccacccagtgggttggtcacgacgtgtgggccacggcatcaagatgtcagagaggcgaagtgacatggcccatcaccccaccttccggaagatctactgtgatgccgttccttacctcttcaagaaggtacgagcagtctacacagaaggcggttggtttgaggaagggatgaagctggaggccattgaccccctgaatctgggcaacatctgcgtggcaactgtctgtaaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggttatgaggcacagactttcaactgggagaactacttggagaagaccaagtcgaaagccgctccatcgagactctttaacatggattgcccaaaccatggcttcaaggtgggcatgaagctggaggccgtggacctgatggagccccggctcatctgtgtggccacggtgaaacgagtggtgcatcggctcctcagcatccactttgacggctgggacagcgagtacgaccagtgggtggactgcgagtccccagacatctaccccgtcggctggtgtgagctcaccggctaccagctccagcctcctgtggccgcaggtaaactacccaggtccctctgagcagccctggtaacaagggtgggaagaagggacagctgttctccggcccctcctccagccccgccctctcctcattgcccagaaccggccacaccgctgaaggccaaagaggccacaaagaagaaaaagaaacagtttgggaagaaaaggaaaagaatcccgcccactaagacgcgacccctcagacaggggtccaagaagcccctgctggaggacgaccctcagggtgccaggaagatctcgtcggagcctgttcctggcgagatcattgctgtgcgtgtgaaggaagagcatctagacgtggcctcgcccgacaaggcttcaagtccagagctgcctgtctccgtcgagaacatcaagcaggaaacagacgactgagccttcctgcctccagcctggcttctagctggaagccagcccagcgtttctctaccaccaccaccatgcctccacctgactttggcttggagactgatcctctctgtgtaaattctgcccggtgctgtgaaggctggacggtggaggacctgctggggtctcctgggacccgcctgttgcttctgccctcccctgtggaaaggtctatatgacgggccgcctgaggccccagaactcgtctgtgaaccaccttttccagccagagttcccaaagctggaacgctagctgcctgctcttccttaagatggcctccccccgacccgccacggccctcagttgccagggatggggccaccactgtcacactgtggaatacaagacagtgaactctgtctgcctgaacgagccatgtaaattaagttctagagcagctctctgagcaggataaggtcccctgacagtgagttgtgtggtgggggcagcctctgcctcaaaaattcaccaagcagaatgcctctcagcctcatgtgttggtcctctgctcctcctagctccccagggatgttggggacccagcttgtctcggcagctaagaagcagtgaccaggatgtggattttggcgacctgtgtggtggccttgagctgctttctgtgtttgtgaggactgactcccatttcctaaaggaaatgcccccggggaggacattgggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcttgcttga

SEQ ID NO: 147167 - DNA, 4217 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000361794
  CDS Start-End: 177-2519
acatgcgcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacagatgctttttaca

SEQ ID NO: 147168 - DNA, 4235 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000368136
  CDS Start-End: 207-2549
agggctgggggcgtcggtctgtccgtcgcgctcagagggaggtgggggtaactagccgctttccagggcgcggggaccgcggctctaccccacccttccacgggagacggagaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacag

SEQ ID NO: 147169 - DNA, 4148 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000368139
  CDS Start-End: 194-2461
cacagcccgcagcgcgaccgtgagagaaagtttaaaagcgggcgtgttcctcccgggtccccgcggagggctgggggcgtcggtctgtccgtcgcgctcagagggaggtgggggtaactagccgctttccagggcgcggggaccgcggctctaccccacccttccacgggagacggaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacaga

SEQ ID NO: 147170 - DNA, 4518 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000529410
  CDS Start-End: 480-2822
gtactggcggctgttgtcacagatagtggcaccaaaggattctttgtagaaaactttgacagcagcctttaaagtcattattcctacaactctgaggcggtgaccgggctattgaaaagatgcacctgaaacaggatctgcgggcagctgcatttgccacccggctttattgctgctttccagcggcgaaggcgcagcagcagtaacagggaagccagagcgagcctccccggcagcggcggcggcggcggcggcaccggcaccagcgcagtttcccctctccccagccctgactctacgcgcacatgcgcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaataaattaggtagtgtattttgagtggcatcagtctcactcatcttggtgccccggtgtttacaagagccagatggtgtcagaggagtacgcagttgtatgcagttatggttggggggaatgtttgtgagggtcttgaactatttatgagatgatcttgagcttctaattttcattgatgaaattgtggtggtttacagagactaagagctcattctgtcaacagaaacactaatctgtacagagcgctgtctcaggtcatgcattgtcctccaaacccaaaggtttttttcagggttggctagagagcgagtattgtgattttgctgaaaagacaaggtgtgaaggagcaacttcagttgacacaaaatttgaaatgctcacagatcagggaggtgatttcccaaagtaattgcccaagaacctccgttttggaaggattcctttttctgtagaatactttgcctcgatatataagcatacagatgcactttaaatgaaaacccttgattataaattgatagctggtagtgtttcttttgcaagaatgcatttctaaggcaaaaggtaaattattttgtccgtcttttgatgtactttctgattccaggattggatatttattcaaggactattttaaaaatagaaagtaagtttgtagcatgctgtctgaattctggggtaagttccacctcttctttagttgctttcgttttttatgatgtaggacttcctttgatatccctgttggaagtccattagcagtcctttgcatttgccaattcaaggtaaaacagggtcagtgacatctgcagtgtcccagtcatttatttgcatgaatctgcttaaataagttttttgttgctgttttttcttttttatgttttgttcagaatttgtacattcaagttgtacttgttatatctgacatgaatgaaataaaatcttaattacagatgcttttta

SEQ ID NO: 147171 - DNA, 762 bp, Homo sapiens
  Payload ID: 9112
  Gene Symbol: L3MBTL3
  Gene Name: l(3)mbt-like 3 (Drosophila)
  ENST ID: ENST00000528385
  CDS Start-End: 192-762
cgcgcgccgcccctgcggccccctccgcccgtgtggcctttgtgccgggcgcgcaccggagagcgagcgagcgggcgggcgagcgcgagaagtacaaaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagag

SEQ ID NO: 147172 - DNA, 665 bp, Homo sapiens
  Payload ID: 9112
  Gene Symbol: L3MBTL3
  Gene Name: l(3)mbt-like 3 (Drosophila)
  ENST ID: ENST00000526087
  CDS Start-End: 177-665
acatgcgcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagcctacacaggtgatttagccaaaagcctgccactttttttctcatctactccgatggttgtaactaacacctatatgctgatgactcctaaatctacatctccagccccgacctctcccccgagctccaggcccgtatttccacctgcctactggacatctccacctggatgtcccacagtcttttcagagaagactgggatgcctttcaggttgaaggatccagtgaaagtagaagggcttcagttctgtgagaactgttgtcagtatggcaac

SEQ ID NO: 147173 - DNA, 3243 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000526019
  CDS Start-End: 244-2511
gtttaaaagcgggcgtgttcctcccgggtccccgcggagggctgggggcgtcggtctgtccgtcgcgctcagagggaggtgggggtaactagccgctttccagggcgcggggaccgcggctctaccccacccttccacgggagacggagaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaacataaa

SEQ ID NO: 147174 - DNA, 3165 bp, Homo sapiens
  Payload ID: 9112
  Gene Symbol: L3MBTL3
  Gene Name: l(3)mbt-like 3 (Drosophila)
  Uniprot ID: Q96JM7
  ENST ID: ENST00000533560
  CDS Start-End: 171-2438
gcattgcgcccgcagccctggaccatttgtcaggactactcgtgagacggagaaaaaaaaaagagaaaatttggggaacccttaggagaaatcttgagagtggacagcaattgtgaagatcgccagagagttctgtgtttcatcaccgccgaaaggttaaaaaataaatcatgactgaatctgcctctagcacaagtggtcaagagtttgatgtgttcagtgttatggactggaaagatggagtgggcacgttaccaggaagtgacttaaagtttcgggtaaatgagtttggagccctggaagttattacagatgagaatgagatggaaaatgttaaaaaagcaactgctaccaccacttggatggtaccaactgctcaagaagtcttttcagagaagactgggatgcctttcaggttgaaggatccagtgaaagtagaagggcttcagttctgtgagaactgttgtcagtatggcaacgtagatgagtgtctttctggaggaaactattgcagccagaattgtgctcggcacatcaaagataaagatcagaaggaagaaagggacgtagaagaagacaatgaggaagaagatcctaagtgtagtcggaagaaaaaaccaaaattatctctgaaagctgacaccaaggaggatggagaagagagagatgatgaaatggagaacaaacaagatgtaagaatcctgaggggttcgcagagagcacggaggaaaagacgaggggattcggctgtactaaagcagggtttgcctcctaaaggaaagaaagcgtggtgctgggcatcctacctggaagaggagaaagcggtggcagtgccggcgaagctgttcaaggagcatcaatcctttccatataacaaaaatggattcaaagttggcatgaaattagaaggcgtggatcctgagcatcagtctgtgtactgtgtcctcaccgtcgcggaggtttgtggataccggataaagcttcactttgatgggtattctgattgctatgacttctgggtgaatgcagacgctctggatatccacccagttgggtggtgtgagaaaaccggccacaaactccatcctccaaaagggtataaagaagaagaattcaattggcagacctatcttaagacatgtaaagctcaagctgctcctaagtcattatttgaaaatcagaatataacagtgatcccatcgggctttcgagttggtatgaagcttgaggcagtagacaaaaagaatccctcattcatctgtgttgctacggtaacagatatggtggacaatcgtttcctggtacattttgacaactgggatgagagctatgactattggtgtgaagcatcaagtccacatattcatccagttggttggtgtaaggaacatagaagaacccttattactccaccaggttatccaaatgtgaaacatttttcttgggataaatacttagaagaaaccaattctttacctgctcctgcaagagctttcaaagtgaaacctcctcatggattccagaaaaaaatgaagcttgaggttgtagacaaaaggaaccctatgtttattagagtagcaactgtggcagacacagatgatcaccgggtaaaagttcactttgatggctggaacaattgctatgattactggatagatgcagattctcctgatattcaccctgtaggctggtgttcaaaaacaggacatccccttcagcctcctttgagccccttagaattaatggaagcttcagaacatggtggatgctcaaccccgggatgtaaagggattggccatttcaagagagcgagacatctgggccctcacagtgctgccaactgtccctattcagaaatcaatttgaataaagaccgtatttttccagaccgcttaagtggtgagatgcctccggctagtccgtcatttccaagaaataaaaggacagatgcaaatgaaagctcttcttcccctgaaatcagagaccagcatgctgatgatgtcaaagaagactttgaagagagaacagaaagtgaaatgagaacatcacatgaagccagaggtgcccgggaagaacccaccgtccagcaggcacagcgtcggtcagctgtctttctgtcctttaagtccccaattccatgtctgcccttgcgctgggagcagcaaagcaaacttcttccaactgtcgcaggaatccctgccagtaaagtttccaaatggagcacagacgaggtgtcagaatttatacagagcttacctgggtgtgaagaacatggaaaggtatttaaagatgaacaaattgatggagaagcatttctacttatgactcaaacagacattgttaaaattatgagcattaaactgggccctgctctcaaaattttcaattccatcctgatgttcaaagctgcagagaagaattctcacaatgaactttgaagatggtgaattctgaataccatcagcattctgctttaaagctcatgttttattcaaagcacaaggacggttataactcctaagtgagaagtctccaaaactcaaaagagcaacactatcggattatttatattactcaagagacaatatatatgaattcttatgaaagtgcttgagcttttaaccaggtactgtctaacaacagtcatcttttggttctgttcactgagctaaatttatctttgtaaatctttttgagtctggggggtggggggaaggggggcttcattaattatttatggtaatggggggcagagtaagaacttttggcattttgtaaacattgttgaattctctttcatgtacactgtttctttttcaatactttcagaaacctttttatataatcaaatttcaatttaaaccaaattagtcgaaacctggctaagtttagccagtaggactgttatctgtattgttaattttgtgccatattttgaattgcaacattatgctaagtataactttgcaagtcatgatattgcctaactgcttgtcataattgtcagggctgaatagttgtaagaatgacttttctttgaatcagtatttttccttttgcacgcattatgaaatgttaaacaaattacttttcaccagcatctttactataattaccaaaaacatgtatataaaagaatgaaattgaaaaataaaatatataaac

SEQ ID NO: 147175 - DNA, 1872 bp, Homo sapiens
  Payload ID: 9113
  Gene Symbol: L3MBTL4
  Gene Name: l(3)mbt-like 4 (Drosophila)
  Uniprot ID: Q8NA19
  ENST ID: ENST00000284898
  CDS Start-End: 1-1872
atgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagtgcttgtgctgcatcccagaggtttggaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatga

SEQ ID NO: 147176 - DNA, 3560 bp, Homo sapiens
  Payload ID: 9113
  Gene Symbol: L3MBTL4
  Gene Name: l(3)mbt-like 4 (Drosophila)
  ENST ID: ENST00000317931
  CDS Start-End: 202-2046
gggcaccgcggggcagcggcgccgcagcctgggctggcggaacctcgcgctccgactcgccccccgcctgtagctcggtcggcgttgcgggcaggcgccgctccgctggggattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttatacctca

SEQ ID NO: 147177 - DNA, 4534 bp, Homo sapiens
  Payload ID: 9113
  Gene Symbol: L3MBTL4
  Gene Name: l(3)mbt-like 4 (Drosophila)
  Uniprot ID: Q8NA19
  ENST ID: ENST00000400104
  CDS Start-End: 202-1806
gggcaccgcggggcagcggcgccgcagcctgggctggcggaacctcgcgctccgactcgccccccgcctgtagctcggtcggcgttgcgggcaggcgccgctccgctggggattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagaggccgagtgcggtggctcatgcctgtaatcccagcactttgggaggccgaggcaggcagatcacgagatcaggagatcaagaccatcctggccaacgcagtgaaaccccgtctctaccaaaaatacaaaaaattagccaggcgtggtggcgggtgcctatagtcccacctactggggaagctgaggcaggagaattgcttgaacctgggaggcagagattacactgacctgagattgcaccactgcactccagcctgggcaacagagcaagactccgtctcaaaaaaaaaaagaaagaaagaaaaaatggtggaaagggtggagaaattccttttaatgggtacaaaccacacaatgcaggtgaccattactctaaaagcccaggcttcatcactatgcaatatatctgtgtaacaaaactgtacttgtgcctgctaaatctgtgaaattaaaaaaaaaaaaaaaccatgaatctgatttgcctttagtcaccagatgactgcagataggcacacagaggtgtgagacagcactttccatttgcccttcatctcttgttcctctgccattccccatgaagccgtgctggggctgacctgctggaggatgagacctgtgaagctgagtcagctgccctggtcatcccagccaaggccatgtcctctctgctcagccaacaactgtccaacaaacatgtgaatgagccctgctgaaatcagaactgaccggcccacctgagcctaaattcctgacaaacagatgtgtgaactaagtaaatacttaaaaaaatgagatgctgatggtccctgaatttctcaagaggcaaagaatggtcccacctcgcaacttataaatgttcagaagttagacggccacaaagaagtagcacctcatatacattctcttgctatctacaataaggtgaaggaaggcatttatcttctctgcaaccagaaaacctataacccaaatgcccaggaacacaagaacactgttcaccattctgctgtgcttattagcagaagatatatcagctcacaaaatcccctttgaaacagaaactaaaataatgctcaatgatcattctactcccacgggggaggagggagaggagcataaatcaggacaagagctgggtttagaacttggatcacgtgtggcttttctccatgatcacaaaccccagcttcctataattaataattggatgtattaagtgttttatggagcagtccagccagagagcaactataaaatggaaacatggaccagcttggtaaagggaaagatgaaattgtagaattaatttgtttgttcgttcattgagtatttcataacaataaacttattgtatttataaagggaaaaacctctgggtgtaatttggctgcctggttgtttatatcctacagtgcagtttcagtatgtttcatgttagtgtgcctgttttaaaatgttttacttcattatcgtaagacgtttttaatgcaatgaaacttcaagccagaaaaatcttagaaaattaacgaaatagggagtagagagaaatggagatagcattaaactaaatacaaagaaaaaattgaaacaaatttttttatttgacaaaaattagccgggtgtggtggcaggcacctgtaatcccagctactcaggaagctgaggcgagagaatcgcttgaacctgggaggtggaggcagtgagctgagatcgtgccactgtacatcaccagcctgggcgacagagtgagactccttctccaaaaaaaaaaaaaagagtctcttcattaaaataaacctaatacttcacttgtttagtaaagcaatgcaaattaatacctgatgataaagtcagaagatgtatatatgtttgtgttcctgctttctttcatttcacagtctaattctcccagactaggatttttgctagctatttgttctatcacccagaattttgagaaggcttaaaagcatattattgatttgtgcatttggtgcaaaattcaacaggtataagggggtatctctccctgaacctgatcctcagccttcagtttcctcccttggaataatcactgtatacttctcttgtgtgtctttctaaaaatatgttctgtttatttaaatatatgtgtgtatgtgtatttacacaagtgatggcataccacatacattgttaaacagtttcctcgtgtcctttagcaataaaatctgacgagcagttcttaacacatggagcggcacactataagtgaccagtccctgcccatggccatctggatggttttcatgttgctgtgtaaaggaggcttcaaagtgtcttctgtaggtgtcagcttgactggaaaataaaaagtgtcttctgtactcatcactcatgcttgtgagaatctacaggatagattctgtgtgtgaatctatcctattctaatccttttcggcatttcctcagctacccttactcgttcatttttccaaatgaactttaatatcagtttttctggtacaacttttttccattccagttggttaatttttggattgcaataaatttatgatttaacttttaattttaccctttgtgaacttgaccatagtaagctgttcccatactcaaatatttcctgtcctgtaattgcattttaagttttcctttatgtagaacttgcgtccttcttacgaagtttattcctaagcagtttatcgtttttgttgctgcaataaatggacgtatttcttccttgatgtcctccacctaagattgtctgtatggaaagattgtatatttctgtgtattacatttaatcctgccactgtaatctcttctaatttgtaatttttttcatgtaattattttgggtttctaggtaaataaacatgtcacctacaaa

SEQ ID NO: 147178 - DNA, 3546 bp, Homo sapiens
  Payload ID: 9113
  Gene Symbol: L3MBTL4
  Gene Name: l(3)mbt-like 4 (Drosophila)
  Uniprot ID: Q8NA19
  ENST ID: ENST00000400105
  CDS Start-End: 161-2032
gtgctctgactttaggtcgggtggcttctggggccttctgaggaacatgcacaagctgctacagctactgattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggtgtgtgtggcgaccatagcagatattgttgaagatcgcttactagtgcattttgacaactgggatgatagttacgattactggtgcgatgttaatagcccttatgtccagccagttggttggtgtcaggagaatggaagaactctgatagcaccccaaggttatcccaatccagaaaatttttcctggacagaatacctggaagctactcaaaccaatgcagttcctgccaaagtttttaaaatgaggttgcctcatggttttctgccaaatatgaaacttgaagttgtggataaacggaaccccaggttaattcgtgttgctacgattgtagatgttgatgaccaaagagtaaaggttcattttgatggttgggaccataagtatgactactgggtggaggcagacagccctgatatccacccgatcggatggtgtgatgtcacagggcatccactggaagtgccacagcgaacgaatgacctgaagatccttccaggtcaagctgtctgtcctactcccgggtgccgaggaataggccatatccgtggtccacgttattcgggacatcacagtgcttttggctgcccgtattcagacatgaacttgaaaaaggaggcaacacttcacgatcgtttgagagaacaaacacaggcaaatttggaatcagactcttcacattcaaaatcaaaaagcctctgtagtttgaacttcaatggaaaacatgaaaaggtgaacagtcagcccagacttgtacagcaggcaaagtgtttgaaaatcaaaggaaaagaagatattgacttggataatctcttcagagtgcttgtgctgcatcccagaggtttggaatactcggtggagcaggcgcagcaggtgcttcaccagtcagtgtccatgtccacggtgtcagcccacccttttcgggaccttcccctcggcagggagcaacactgcaagttgcttccaggcgtggctgacatccgggccagccaagtggcacgttggactgtggatgaggtggctgagtttgtacagtctcttctgggctgtgaagagcatgccaagtgctttaagaaagagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaatttatacctca

SEQ ID NO: 147179 - DNA, 549 bp, Homo sapiens
  Payload ID: 9113
  Gene Symbol: L3MBTL4
  Gene Name: l(3)mbt-like 4 (Drosophila)
  ENST ID: ENST00000583809
  CDS Start-End: 182-549
aagaaggacgccgccgcccgcgtgggatggtcgcgagcccgcgtgggtgcccacggccgccgccgcgcggggtggccccatccccgggcagattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaag

SEQ ID NO: 147180 - DNA, 568 bp, Homo sapiens
  Payload ID: 9113
  Gene Symbol: L3MBTL4
  Gene Name: l(3)mbt-like 4 (Drosophila)
  ENST ID: ENST00000581231
  CDS Start-End: 328-568
agacggtgaaccccaagagctgggatgaagcatgggtgagctactgggacttcgctgccagggagcaagctggcaggcaggaagtagccaagatttgggggaatccttcccagggaacgaatacagagaaggacgcatctgaaaattccgccgcagccacctccctcccatgggaaagccccgacctcggcgggcccagcgccacccggctccccggggtgtggaacactgagcgagattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatg

SEQ ID NO: 147181 - DNA, 1002 bp, Homo sapiens
  Payload ID: 9113
  Gene Symbol: L3MBTL4
  Gene Name: l(3)mbt-like 4 (Drosophila)
  ENST ID: ENST00000583054
  CDS Start-End: 377-1002
tgcagttggatatgacaagtatgcacaactagctgatgacatctcatagcccagagtgggaagcagcctttcctcctctactcatcatccatctctcttactcatagaaccctgctttcctttatgggaattatgagagaagacttagggttttccaggaggcagatcctccatttccccatggctttgtccaagagtgcaggaagaagatctaagattggtcaattggatgctctttcccaggactttggcttgagggacagagactctagcaagaagggaacagattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttccttggt

SEQ ID NO: 147182 - DNA, 5004 bp, Homo sapiens
  Payload ID: 9114
  Gene Symbol: L1CAM
  Gene Name: L1 cell adhesion molecule
  Uniprot ID: P32004
  ENST ID: ENST00000361981
  CDS Start-End: 109-3855
tgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 147183 - DNA, 3888 bp, Homo sapiens
  Payload ID: 9114
  Gene Symbol: L1CAM
  Gene Name: L1 cell adhesion molecule
  Uniprot ID: P32004
  ENST ID: ENST00000361699
  CDS Start-End: 12-3773
cgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatc

SEQ ID NO: 147184 - DNA, 4655 bp, Homo sapiens
  Payload ID: 9114
  Gene Symbol: L1CAM
  Gene Name: L1 cell adhesion molecule
  Uniprot ID: P32004
  ENST ID: ENST00000370055
  CDS Start-End: 199-3945
catcggcatcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcc

SEQ ID NO: 147185 - DNA, 692 bp, Homo sapiens
  Payload ID: 9114
  Gene Symbol: L1CAM
  Gene Name: L1 cell adhesion molecule
  ENST ID: ENST00000370058
  CDS Start-End: 1-462
gaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttggg

SEQ ID NO: 147186 - DNA, 5113 bp, Homo sapiens
  Payload ID: 9114
  Gene Symbol: L1CAM
  Gene Name: L1 cell adhesion molecule
  Uniprot ID: P32004
  ENST ID: ENST00000370060
  CDS Start-End: 191-3964
tcgcagacgcgctcgggcggcgggtccgaggccggcgtgcgcggaggctgggcgggcagcccgagcggtggccgcagcgcagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggcctcttccagccgcccccaccccccaggaccccttagcagccctgccctccctatcgtctgaacagttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 147187 - DNA, 576 bp, Homo sapiens
  Payload ID: 9114
  Gene Symbol: L1CAM
  Gene Name: L1 cell adhesion molecule
  ENST ID: ENST00000407935
  CDS Start-End: 192-576
ttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagg

SEQ ID NO: 147188 - DNA, 569 bp, Homo sapiens
  Payload ID: 9114
  Gene Symbol: L1CAM
  Gene Name: L1 cell adhesion molecule
  ENST ID: ENST00000420165
  CDS Start-End: 300-569
acagccgctgctgccgcagcatcggcatcgcagacgcgctcgggcggcgggtccgaggccggcgtgcgcggaggctgggcgggcagcccgagcggtggccgcagcgcaggaactccaggcagaacctgagaactgacaggcaggtgtgcagggcacatgtgcagggcaccgctggaggttcccttctcaagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaattgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttc

SEQ ID NO: 147189 - DNA, 637 bp, Homo sapiens
  Payload ID: 9114
  Gene Symbol: L1CAM
  Gene Name: L1 cell adhesion molecule
  ENST ID: ENST00000458029
  CDS Start-End: 387-637
gagtgcaacccctcccagagaagacacaccacagaaataccagctcacatacagctcactccctgcttgcagatccacaaccacacacatgcccacggacacctgcacatgcagacacatacggggatgtgcatgccatgcacaggggagctgatggggcaacaagttggtgctgggaaggcagctggcaggaaaggtgcagacagagagtagagagggaataaaaggcaacctagaggcccagccagggctatctcttccagatttctccctccaagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgt

SEQ ID NO: 147190 - DNA, 570 bp, Homo sapiens
  Payload ID: 9114
  Gene Symbol: L1CAM
  Gene Name: L1 cell adhesion molecule
  ENST ID: ENST00000455590
  CDS Start-End: 1-570
ttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcg

SEQ ID NO: 147191 - DNA, 655 bp, Homo sapiens
  Payload ID: 9114
  Gene Symbol: L1CAM
  Gene Name: L1 cell adhesion molecule
  ENST ID: ENST00000439496
  CDS Start-End: 204-655
aagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaagg

SEQ ID NO: 147192 - DNA, 1377 bp, Homo sapiens
  Payload ID: 9115
  Gene Symbol: L2HGDH
  Gene Name: L-2-hydroxyglutarate dehydrogenase
  ENST ID: ENST00000261699
  CDS Start-End: 19-1344
ggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggcaggtggctgtgagaggaccgagctggctatggcagcaacccatgaaagtgagtgataacaacatttattgtttcctgtggcgttgctttgctttgctattgactggtagcgcttgtagctttaaataaattgaggaagtatgagagagtaaatggaagaaa

SEQ ID NO: 147193 - DNA, 6414 bp, Homo sapiens
  Payload ID: 9115
  Gene Symbol: L2HGDH
  Gene Name: L-2-hydroxyglutarate dehydrogenase
  Uniprot ID: Q9H9P8
  ENST ID: ENST00000267436
  CDS Start-End: 399-1790
agtttctcccacggccccatgtccgcatggcggtgaaggtcgaagacgcgcgacccaaagggccaggttttcagtcagcccagcgttggcgacgggcgagggcagaacacaaccaccaccctagtcccgcccggctcggggcctagcttctctactcacagcgtcggagggagggagggagggagcgagccagcgtccccgcgtctgcggcaccctggccggcccttcgccctccgacgcgcgcgcctattggccaccgcagcctctcccacatggggcgaaggcgcgccacttcattggcccccgcgtgaggggcggggctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttagtttttaggtcaaagataaccactgcattgttaaaatgatgtaacatagaaataataattttctacaaaaattagccaggcatggtggcgcatgcctgtaatctcagctactcaggaggctgaggcaggagaatcaattgaaccgagcagacggaggtgagctgagagctgagattgcaccactgcactccagcctgggtgacagagcaagaaaataataataataataattttcaaaatgttaggctgggggccgtggccagcactttgggaagccaaggcaggtagattgtagcccaggagtttgagaacagcctgggcaacatggcaaaaccctgtttctacacaaagttagctgggtctggtgcctctgtagttccagctcctcagtaggctgaggtgagaggatcacttgagcccaggaggtctaggctgcagtgagcttatgttcatgacactgcattccaggctggatgatagagcaagatcttgtctcaaaaaaaaaaaaaaaaaaaaaaaaaatccagcctgggcaacatagtgaatgaaaccccatctctacaaaaaatacaaaaattagctgggcatgatggtgtgtgcctgtagtcccagctacttgggggctgaggcaggaggatcgcttgagcccgggagatcaaggctacagtgagctgtgttcatgccactataccccagcctgggcaacaaagtgagtccctgactcaaaaaataaaaacaacaacaaaaaataaattccatgcttatttactttgcgaataaagaggcaaggtacagttttatctgtccgaatccctgacttttatttattttttttttcagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttacattcttttaattttgaagagtcacaaaactcacattatttagagcaacaatatttgtatttggaaattaaaaattcatgatttcaagaaaatacataaaatttacatttttgagtagtttgaataagtttctatcttaattataatatttgtaggaaataacaaaacaaactcaaagcctttattatttccagtctctttgtaactgatgtggtatggtatcatcatgaaatctaaacagtggtacactgagtggttgtcctgttcttcaatctctgtggctgagaactgaaataacttagaagagacagatttttatgagagcagttttagaatcctgacactgatgtatagaactccaatttaaaaaagttatttatctattatatctctgatctttagtcacactaaggctctcaaaatgttggccaagattggtaatgattcatacgtacttgatttttcagggctcctataaacttgtatagggatatttttccatttttgataaatatctaactttgaggcattcacttttgtaaaccgcgaaagtgccttacattcacctcatgagtattttaagttgatgcccagtgctgtggtatatcctgtatatatgtgttttgtggtatctatcgaaattattcttataatttagaaagttagaaaatagaaattgtaaatgaaaatgtggcgacctgactgcagaactttgagtactgaaccacatttaggtgaggcattttcatccattctctctgatttgctctctcaggattcatcttctactgtgtatgtcttctttcctcttagctctccaaagctgtatgatggatgggtgagaaggatgtgcattttggttgataggaaaaatgtttctgttttcttccttttcccctcacttcaagcattgatgattacattgattgagctacctcatccattaatttgaaaggctacacttcatcagctcatgtttaagaagtagcacatcccaggtaaacagagtaggccattattcaactcttaggatgagtatattaaaagcattcagatatcaatgacagaagaaacaagccctaatgtttctttataacagctgattcctgcaagaaatgcaaacacaggatatttttctgttccattacaagattactaagagatggaaaatattatcattctgtattttgtcagtagtacgattgcatacatactaagttgtaaacattgaattacaaaaaatgattgtcctaattgaagcagtcctcaatccatttgagtctgtacaataccctgaaaaggaaacaacaggtgctggagaggatgtggagaaataggaacacttttacactgttggtgggactgtaaactagttcaaccattgtggaagtcagtgtggcgattcctcagggatctggaactagaaataccatttgacccagccatcccattactgggtatatacccaagggactataaatcatgctgctataaagacacatgcacacgtatgtttattgtggcactattcacaatagtaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatgttctcactcatagatgggaattgaacaatgagaacacatggacacaggaaggggaacatcacactctggggactgttgtggggtggggggaggggggagggatagcattaggagatatacctaatgctaaatgacgagttaatgggtgcagcacaccagcacggcacatgtatacatatgtaactaacctgcacattgtgcacatgtaccctaaaacttaaagtataataataaacaatatatatatatatatatatataaaataccctgaaaaataaaaatgaaaaatttgttgaaagtgttttgaatatgtaggttattctgcttgtaaaacgttttatatgtatgtcaatagggtttttttgtttaatactgatataataaagttttatgtatttctgacagaagaaatgtatattaatatttaaaatattttaatgagccttggtgttgtagagaacatattttttagttccataaaaacttttatgcaaataaatttttttatgtgtaaaacataaactgtttgctttagatagatagcagccaacctttttaaaaaactcatttctgtgttagtatataatacaaaatgaggttgagtcatttatattttgggtaaaaagtggagcattttagattttaacttcagagtgtttgtgaggaactcttgatgtaccagcaagtatatttttggtgtttcatgttacgtagcttaactcttttatccatacatatatgtgtatatcaaagtccttcccttgatcctctcagcattagcactgtttggggagttgcctttactgttggcagaattccactttccctgaggccatttggaaatctacctagtagcctgtgggataaccttaactcttagaactttcttcaaaggatggtggtgagaatggggtatactgccaggccctggcctacgggagtttgtagggcctacttttggaggcaatccaaccctgatggctgtacctatgagctatccctgtaaacacaggagacatggtgtctatattgtttaaggactggctctgccctcctgggcccttaatctgtgtctagacttcttggtcagaggtttcctcatctttctgcgcatacactattatctaaagatcttgtaaacatttttgagttgtaatcgtaaagtcagtttctaagcttttctaacacactcaaagggagtttttgaaatctcttcatcagggcttaaggtagaaggacagggtgaaatggttgggaaagcaaaagctgcctcgagatgttttcaaatagtttgtactcattaaatagcttaagaatggaaataaaccctgaagccctgaagggaagaacagtgttgataccaaccaactctacttttctggcctcaaatcctagaaagtattgtgggtttgttgttgttgttgatgttgttaattgcttgtattttctgcttatgggaaggatctcacattaaagttatcttattttaa

SEQ ID NO: 147194 - DNA, 1958 bp, Homo sapiens
  Payload ID: 9115
  Gene Symbol: L2HGDH
  Gene Name: L-2-hydroxyglutarate dehydrogenase
  Uniprot ID: Q9H9P8
  ENST ID: ENST00000421284
  CDS Start-End: 80-1471
gctaaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctagacggagtttcactcttgttgcccaggcttgagtgcaatggtacgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccatcatgctcagccctgaatccctgactttgttaatgacctgtccttaccaaccatgacctagagaagatttggctttttaagagttttggagaaagatggcataaaaatagattatttccttaaatcaattttttagcattacgctacctaagctcgtttggtctctcatagacaagaaaatacattatattgtaggttaca

SEQ ID NO: 147195 - DNA, 841 bp, Homo sapiens
  Payload ID: 9115
  Gene Symbol: L2HGDH
  Gene Name: L-2-hydroxyglutarate dehydrogenase
  ENST ID: ENST00000555423
  CDS Start-End: 77-787
aaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatgctgaataacgagcaagaatttcagattaacaaagatgtcaggtggaaagcttcattggttta

SEQ ID NO: 147196 - DNA, 597 bp, Homo sapiens
  Payload ID: 9115
  Gene Symbol: L2HGDH
  Gene Name: L-2-hydroxyglutarate dehydrogenase
  ENST ID: ENST00000554191
  CDS Start-End: 77-277
aaagagcgcgggtcctcggccgtggagggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagaagaaacagtttgtgtgaaggctgtaaggcttggagaggttttggctattttgacgactagaagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctat

SEQ ID NO: 147197 - DNA, 804 bp, Homo sapiens
  Payload ID: 9115
  Gene Symbol: L2HGDH
  Gene Name: L-2-hydroxyglutarate dehydrogenase
  ENST ID: ENST00000555610
  CDS Start-End: 5-640
ggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcatcgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggatatccagttgtgtcagcatcacttatcaaaaaaccattattttcccactgtgctgcagtattgcctttatgatatcagggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggtaagccatccttgtctt

SEQ ID NO: 147198 - DNA, 393 bp, Homo sapiens
  Payload ID: 9116
  Gene Symbol:
  Gene Name: L34079.2
  ENST ID: ENST00000594374
  CDS Start-End: 1-393
gcggccgccgcctctcacccaacgcactacgacgccctcatcctcgtcacccctggggcccccactgagaaggactgggcccaggtccaggccttgctgctaccagatgcgcctcttgtctgcgtgcgcacagacggcgagggcgaggatccggagtgtctgggagaagttggagaaggaggagcagatacacagtgtggacattgggaatgatggctcagctttcgtggaggtgctggtgggcagttcagctggaggcgctggggagcaagactatgaggtccttctggtcacctcatctttcatgtccccttccgagagccgcagtggctcaaaccccaaccgcgttcgcatgtttgggcctgacaagctggtccgggcagccgccgagaa

SEQ ID NO: 147199 - DNA, 1527 bp, Homo sapiens
  Payload ID: 9117
  Gene Symbol: L3HYPDH
  Gene Name: L-3-hydroxyproline dehydratase (trans-)
  Uniprot ID: Q96EM0
  ENST ID: ENST00000247194
  CDS Start-End: 115-1179
cgccccccggacgtggctggttagcgtcccgccctcctcccgcggagtcagtgggtgagggtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataatatgtgga

SEQ ID NO: 147200 - DNA, 758 bp, Homo sapiens
  Payload ID: 9117
  Gene Symbol: L3HYPDH
  Gene Name: L-3-hydroxyproline dehydratase (trans-)
  ENST ID: ENST00000481608
  CDS Start-End: 333-758
gcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacaggtaatgggcgggacctttccagcccagggcagagctgcaaccgggacgcgactaactacattaacggtttttctgggctggaactctggcaactaacctactccgcgaaaccttgcaattaatagaaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagg

SEQ ID NO: 147201 - DNA, 700 bp, Homo sapiens
  Payload ID: 9117
  Gene Symbol: L3HYPDH
  Gene Name: L-3-hydroxyproline dehydratase (trans-)
  ENST ID: ENST00000487285
  CDS Start-End: 202-639
agaaaggtaaatcactgccaacgtgtgtcagcagccttgcgtatttggtgcgtgtaatttcgattttccctgactcccatccgcctgtggttttgggagacccttgaggagcgaggaattgcgtgttaccctgactcagcgcctccctctgcactggtgaggcattcctagagatttcaccggtggataaagcaagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacagaggcagtgaaagctcagtttaaaattaatcatcctgatagtgaagaccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggagctgttatgagaagaatctgggattgcaatgtccccccaaatagagagggagccgagagaccaaagaatga

SEQ ID NO: 147202 - DNA, 6595 bp, Homo sapiens
  Payload ID: 9118
  Gene Symbol: LARP1
  Gene Name: La ribonucleoprotein domain family, member 1
  Uniprot ID: Q6PKG0
  ENST ID: ENST00000336314
  CDS Start-End: 25-3084
gtgaccccaggccctggtcactccatgctttggagggtgcttttgtcaaagaggcctcctttccctcacccagagctggatttccaagaggctcccatacctagctgccctggcagactcccagggaggaaaaacagcgtggccttggcagctgccccgaggaaggagcccacaggtgacagggagaagccattgccattccctgtcctggcccccttcagcaaccctgaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatgagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacagatatggtttggagtgcctttttcgatactacagttatggcctggaaaagaagttccggctggacatattcaaggattttcaggaggaaacggtgaaggactatgaagctggccaactgtatgggctggagaagttctgggccttcttgaaatattccaaagccaaaaatttggacattgaccccaaactgcaagaatacctcggcaaattccgacgtcttgaagacttccgagtagatccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggaaaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaata

SEQ ID NO: 147203 - DNA, 450 bp, Homo sapiens
  Payload ID: 9118
  Gene Symbol: LARP1
  Gene Name: La ribonucleoprotein domain family, member 1
  ENST ID: ENST00000518194
  CDS Start-End: 1-450
gcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctgcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactactt

SEQ ID NO: 147204 - DNA, 817 bp, Homo sapiens
  Payload ID: 9118
  Gene Symbol: LARP1
  Gene Name: La ribonucleoprotein domain family, member 1
  ENST ID: ENST00000521577
  CDS Start-End: 1-184
gaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagatgaagctgctgagacttgcagaggttaattactagcccttgatggccaagtggggattggaagtcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgaca

SEQ ID NO: 147205 - DNA, 2630 bp, Homo sapiens
  Payload ID: 9118
  Gene Symbol: LARP1
  Gene Name: La ribonucleoprotein domain family, member 1
  ENST ID: ENST00000518297
  CDS Start-End: 184-2630
ggatttacggcggctgcatctaactgggagggggccgcacctcgcgtgaaccccgacccttctctgcagggactggggcccagcgccccggaggaaggcgtcgcgggcgctctgctagccaagttcgaggcgggggaggcagcctcgggcgcgcccggcttctccgggggggcgggcgcgcagatggccactcaggtggagccgctgctgcctgggggcgccacgctcttgcaggccgaagagcacggggggctggtgaggaagaagccgccgccggcgcccgagggcaagggcgagcccgggccaaacgacgtccgcgggggggagccggacggcagcgctcggagaccccggccgccctgcgccaagccgcacaaggagggcaccgggcagcaggagcgcgagagcccgcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcg

SEQ ID NO: 147206 - DNA, 399 bp, Homo sapiens
  Payload ID: 9118
  Gene Symbol: LARP1
  Gene Name: La ribonucleoprotein domain family, member 1
  ENST ID: ENST00000518892
  CDS Start-End: 1-202
cggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagataccctttagggctggtttgccttagttgaggaagaagaccctcctagggactctgtctgccatccaccctgctacagtctgggcctcggagacctgtggacagataagctgctgggcccagtcatcagtaactgtttactcagaaaaacaagggaagtgctctaagattacactaagaaggcttttgacccattcctcgccagtag

SEQ ID NO: 147207 - DNA, 569 bp, Homo sapiens
  Payload ID: 9118
  Gene Symbol: LARP1
  Gene Name: La ribonucleoprotein domain family, member 1
  ENST ID: ENST00000519931
  CDS Start-End: 292-569
acggccaccgcctgggccgcagcggttagtgggcaacggtgtggttcgggcctacctcgtcggcagagggtgggcgctggtttcagtgaaacgatccccaccgcatgctggtaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcc

SEQ ID NO: 147208 - DNA, 501 bp, Homo sapiens
  Payload ID: 9118
  Gene Symbol: LARP1
  Gene Name: La ribonucleoprotein domain family, member 1
  ENST ID: ENST00000517616
  CDS Start-End: 1-501
gcggccgctgcagctgcccggcgccgaaggcccggccatcagcgacggggaggagggcggcggcgagccaggcgctggcggaggagctgccggagccgcgggcgcggggcgccgggacttcgtggaagcccccccgcccaaggtgaacccgtggactaagaacgcattgccgccggtcctgaccaccgtgaacggacagtcccccccagaacactctgctccagccaaggtggtgagggcagctgttcctaaacagcgcaaaggcagcaagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccag

SEQ ID NO: 147209 - DNA, 2128 bp, Homo sapiens
  Payload ID: 9118
  Gene Symbol: LARP1
  Gene Name: La ribonucleoprotein domain family, member 1
  ENST ID: ENST00000524248
  CDS Start-End: 297-2128
acgtggtgcctccccgcgcggggagcggcatgtgactgccgaccggcgctccgcgagtcctccctctccctcctccgcgttttggtccttttggaccgtgcccctttccggggggagaacactctgctccagccaaggtggtgagggcagctgttcctaaacagcgcaaaggcagcaaggttggtgactttggagatgcaatcaattggcccacacctggagagatagcccacaagagtgttcagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaacccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcg

SEQ ID NO: 147210 - DNA, 467 bp, Homo sapiens
  Payload ID: 9118
  Gene Symbol: LARP1
  Gene Name: La ribonucleoprotein domain family, member 1
  ENST ID: ENST00000522272
  CDS Start-End: 1-109
aagacacagttcaaacccacccttggagagccatgtgggctgggtgatggattcccgtgagcacaggccccgtactgcttccatcagagatggcacagactgcaaataggcatgcttttgaagaaaatatacaattgatctttgaacaacgaagggcgtggggtgcccagctgcacacagttgaaaatccgtgtataacttttgactctccaaaagcctactgttaaccagaagccttaccaataacatatagtcaattagcacatgttttgcatattatatgtattacatactgtattcttacaataagctaaataaaaaatattactaagaaaatcacaaagaagggaacaacaaacactggggcctacttggtggggagagggaggagagtgaggtacagtttacctacttaacaaacctgtacacatacctctgaacctaaaataaaagttaaaatcataaga

SEQ ID NO: 147211 - DNA, 843 bp, Homo sapiens
  Payload ID: 9118
  Gene Symbol: LARP1
  Gene Name: La ribonucleoprotein domain family, member 1
  ENST ID: ENST00000523163
  CDS Start-End: 1-843
gatgaatcaggggaggaaaagaatggagatgaggattgccagcgaggcgggcagaagaagaaaggaaacaaacacaagtgggttccattacaaatagacatgaagcctgaagtgcccagagagaaactggcttcacgccccactcgcccaccggagcctagacacatacctgccaatcgcggagagatcaaagcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaag

SEQ ID NO: 147212 - DNA, 827 bp, Homo sapiens
  Payload ID: 9118
  Gene Symbol: LARP1
  Gene Name: La ribonucleoprotein domain family, member 1
  ENST ID: ENST00000518677
  CDS Start-End: 1-551
agcaggacctgtgggctgaaaagtttgaacctgagtattcccagatcaagcaagaagtcgagaacttcaaaaaggtcaatatgatcagccgggagcagtttgacacactgacccctgagccccctgtggatcccaaccaggaagttcctcctgggccacctcggttccagcaagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaagatgcctcgaaaaagaaagacaagacacagttcaaacccacccttggagagccatgtgggctgggtgatggattcccgtgagcacaggccccgtactgcttccatcagtaagatggccccagtgtgtgtttcctgtttcccaaagcaagctttgagagccacctacctatgaccaatgctctctactccctgcagagatggcacagactgcaaataggcatgcttttgaagaaaatatacaattgatctttgaacaacgaagggcgtggggtgcccagctgcacacagttgaaaatccgtgtataacttttgactctccaaaagcctactgttaaccagaagccttaccaataacatatagtcaattagcacatgttttgcatattatatgtattacatactgtattcttacaataagctaaataaaaaatattactaagaaaatcac

SEQ ID NO: 147213 - DNA, 587 bp, Homo sapiens
  Payload ID: 9118
  Gene Symbol: LARP1
  Gene Name: La ribonucleoprotein domain family, member 1
  ENST ID: ENST00000518742
  CDS Start-End: 1-587
gagctttacagtgtggatcaggaactgctcaaagactacatcaagcgccagattgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaagaagtcagaggagtccagattttcccacctgacctctctgcctcagcagctgccttcccagcagctgatgtccaagga

SEQ ID NO: 147214 - DNA, 4891 bp, Homo sapiens
  Payload ID: 9119
  Gene Symbol: LARP1B
  Gene Name: La ribonucleoprotein domain family, member 1B
  Uniprot ID: Q659C4
  ENST ID: ENST00000326639
  CDS Start-End: 212-2956
gctctcgggccgcccctcttcgccgtctccacgcctccgcgggcagttaccagctttggctgctcgcgcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaaggaggtgttcaaggagtgcttcacattcccaagaaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgatccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaa

SEQ ID NO: 147215 - DNA, 2151 bp, Homo sapiens
  Payload ID: 9119
  Gene Symbol: LARP1B
  Gene Name: La ribonucleoprotein domain family, member 1B
  Uniprot ID: Q659C4
  ENST ID: ENST00000394288
  CDS Start-End: 145-1152
gcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatca

SEQ ID NO: 147216 - DNA, 2707 bp, Homo sapiens
  Payload ID: 9119
  Gene Symbol: LARP1B
  Gene Name: La ribonucleoprotein domain family, member 1B
  ENST ID: ENST00000432347
  CDS Start-End: 132-1208
gggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatca

SEQ ID NO: 147217 - DNA, 3105 bp, Homo sapiens
  Payload ID: 9119
  Gene Symbol: LARP1B
  Gene Name: La ribonucleoprotein domain family, member 1B
  ENST ID: ENST00000512292
  CDS Start-End: 194-1750
ttcgccgtctccacgcctccgcgggcagttaccagctttggctgctcgcgcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtgacaatactgagaacgccctttctcgtatgaaagaataaaaacaagttactgtggacaggcttaatttatatgctcattgcttacctggctctcaccgcagctgtatgagccagtggctttagagagcactcttcttgcctctttctgttttccccacttagtctatggtgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagccttagcagttctctgcctgtcctactgctgtgggaaaggaagtgtgtttttataatgcttctcagttgaaagtctttcctagtgtaagcattgctattttatttgtaatacttaggttcggtaagtaatacctatcttaaatccttttagaacagagatactagtacattctactaataatcagttaaaattatccttcccccattctctatccctttacccagctttgtttttcaccatagcatatatcattatctataattctatatattttacttacttttattctcttggagaaaaaactatggatgtaataccaatgacaataggatttttttctatttgttcattactattgtatttctagtgttagaatagtttctggcacaaagaaatgttcaattcatgtttgtgggtaaataaattatggagtaaacattatgcattaaccaaaggaacccaaccattgtgtataatatttgttctgtgggaaatgttttcagtctgccaagtaacaaatttgtaagccaacttgagaaacatcctatttgtaggtgattatttccttaaattatagacaataattaaaagccatgtattgagttcttga

SEQ ID NO: 147218 - DNA, 1513 bp, Homo sapiens
  Payload ID: 9119
  Gene Symbol: LARP1B
  Gene Name: La ribonucleoprotein domain family, member 1B
  ENST ID: ENST00000507259
  CDS Start-End: 1-78
aatgatggcttatactattatgaacaggatctatggatggaagaagatgaaaacaaacacacagccataaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtccaagaaagagaaaaacaaggcatagcacaaatccccctctagagtgtcatgttggttgggtaatggattccagagaccgtgggccaggaacatcctctgtcagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtgagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtatgggttagaatgtctgttcaggttttatagttatggactggaaaaaaaattcaggcgagaaatttttcaggatttccaagaagaaaccaaaaaagactacgaatctggtcagctgtatggactagaaaagttttgggcttatttgaaatattctcaatctaagacacagtctattgacccaaaacttcaggaatacctctgtagttttaagaggttagaagacttccgtgttgataatcaccatgatcgattacttctgctcatcataaacatctagttcctaagcaggatatgagaatctgccttcctgtgacctctcctgggctcagtgacactccagtcgccgccccaccccacatcaatgccacttccaagtttgacttgcatcttacaaaccatatttctgtttactttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctctacttgtgttaagacctgtctccaatagacattccaattgaggattgtggaaatagcaaattacattggtgtctgcccaccactgaaggcaaaaagctggtttatctaggccacaggcagagcccgcaggggaggcaggtaacttctcggaccaccagattatcttgatcttcagccagctttattgttgttctacattttaataaacactacatgtttatttta

SEQ ID NO: 147219 - DNA, 1593 bp, Homo sapiens
  Payload ID: 9119
  Gene Symbol: LARP1B
  Gene Name: La ribonucleoprotein domain family, member 1B
  ENST ID: ENST00000507377
  CDS Start-End: 1-1474
agaagagaaggttgaaaagagaagtaacagtgacagcaaagaaaaccgggaaacaaaattaaatggtcctggtgaaaacgtcagtgaggatgaggctcagtcaagtaatcaacgtaagagagctaataagcacaagtgggtaccactccacttagatgttgtaagatcagagagtcaagaaagacctggatcccggaacagctcaagatgtcaacctgaagcaaataaaccaacacataacaataggagaaatgatacacgaagttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctg

SEQ ID NO: 147220 - DNA, 1891 bp, Homo sapiens
  Payload ID: 9119
  Gene Symbol: LARP1B
  Gene Name: La ribonucleoprotein domain family, member 1B
  ENST ID: ENST00000508819
  CDS Start-End: 168-1891
agttaccagctttggctgctcgcgcctccccaactcgggtaaagctcctcggcctcggcgtgctgcgcctccgcggctgccctgcgccagaattcggttccctcaaaattataaaggcaggaaagctcaagacaaagaaatccaacaaggctagtgatttcagtgatatggagaattggccaacaccaagtgaattagtgaacactggatttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgattgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaattgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaagcaagaagttgagaactttaagaagctaaatctcattagtaaagagcagtttgaaaacctaacacctgaacttccttttgagccaaaccaagaagttcctgtagcaccttcacagtccaggcaagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaagagtcc

SEQ ID NO: 147221 - DNA, 6296 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000293618
  CDS Start-End: 203-2164
agacccggaagcagttgttgtttcaagggaggtgggactgggcgggtcaggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattatt

SEQ ID NO: 147222 - DNA, 3621 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000347328
  CDS Start-End: 27-1988
aacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaa

SEQ ID NO: 147223 - DNA, 6427 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000398473
  CDS Start-End: 113-2287
ccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggttaaaattacattactgtgaaattcatcttccaactctaagttaagctttggagatacatgttagtggttaactgttaagagctttgaaaacactgcacatatctgtacaagccagaattactatttctttgacttattattagcttggcagttgcttttgatttgattgttttatgacatggtatactactatatttactcagtttgaaactattcatttctacacactatttttaaaaattgcctactaggtgaaacataacaataaaactacctgtgctgaaatttgggggaagtttaggtcctttaaaaaaacatattaatcattgactacatctatgataaaagtgcttattttggtttactaagataatgcagttggtggaaatgataaacgttttaagtgttaacatcctttgaatgcgttggatttcagagaataaacattttgtaaaaatcacttggtaaggattataaacttaattactgcacttaaaatgaaacattactttttttaaacaatgtgtcacaaatgtaggtctgtattacttgtatgcttgtgtgacttactgttagtccagctctaaaaatttaaaggttgtaattgaaatacaagaaaagagccttcttttagaagaaagcaagtatatttttgcttttacttcaaatgttatttaaagtagaaatttaatttgtagatataacctttaaaaattttctcattaagacaatgtttttaatttaatttgcctcattacatctaatagttcccatttgatggcatgtatagggaagagtgagagagtgtgtgtgtgtgtatgtgtgtgtaatatttatatatattcacagtatgtatttagcatttattttattacagcagatttaaagtttgtatctaaataatgcctatgagttgtgtgaagctcttggcttttttccaacgttactttgtaactaatgagggtggatgttcattgtagtttatttatttggttctttagatggaggaatttaaaaaatcaaatttttctcttcacctttatgacttgacatttccttgatctgttggaggctaaaagtaggtataaatgatattgaatgttgggtatagtgatactctgccatagttcttactgcatgaagagaacaagagtcacacaagttcaccactttgcacttcatagagaaggtacatagagacattgcaaaacctgtctccatttgctatcctgataattaaggttttcataatacctagggcctgtctctgagtaattttaattttgccaaatacactgacatttaaaatagtgatccatctaaatttttttcagctgggttttgaggaatataagagctttcaatgataaaggtttgttgtagttgtcttatgtgctgaatttgcagatgatcagatgctgtgcagaattctgatttatttttgtttcctaaaattaagatagcttgaatattatttcacattcctttttcttttttaaataaacaggtttgctttggaaaggcttaatgatggaatgttagcatcttcactagggtaaagaagaacaaaaagaatgttgctggaacgtaaaatagtatttaaaagttaatgaacacttctctagttttcttagttatggccttaataattagtctcttggcttaaatgtccactggttttactttgacacagttgaacaacactggggttaagtctctggtatttaggctggcaatatatatattaaccatattttaaaagtaccaattttgtttttacagaaaagataaaactcaaaagagaacagtgtattccttctgaggggcttttataaattattaactataatatatgatggattttttcctaattttttatatttccttacaattttggtggccattaatttaactttaggcttttgggcatatgctagtctgagcttccgaaaagatacatatatgtttcccttttcattagctgaatgaggatattttaagaagttgaaagagaatttattttcaagttgtgagtaaatcctcctttgaaattcacctgattattagataacttaaagtttatttttaaaagctgacaactttttatgaatcttcgagttgacagttcctaaaagcgtaactcagatattaatgggctgtgtattaaatggttttattttcagttttgcagcacagaacactgttgaaatatccatatcaacttgatttttttaacctaattcaggtgtcctttgcatctcttaaatgttgggggtgggggtcagagccagttatccggcttctgttttgtcgattgcttagatttgttcctgttgtcaaaactgttacccccaaaattggtgtgacacatgctcatgcataaaatgttaaaatgagtacatccttgtatttgtatttgttttcaacatcgccaaggtgctatgggaaattaacaaaattagaaaaaaaataaaattattaaaaagca

SEQ ID NO: 147224 - DNA, 4000 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000429001
  CDS Start-End: 155-2347
aggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaatacttgagtagatttttttttctagtttgaaatttagtctgtctttttgaccttactaatatttcatttaacaagttgtaaaactctgattgtacttagagatgtgactaccaatcagtttgatactcaaggaaagggggttattcaagaaattgaaaatttcatcttggacctcagtgcataggtcaaatggatttcagaggtttaaacttccctgtgattcccccgaatacccccaaaatgagaaacaaaattttttttcttactccatttgttactctctgttctttgactgcccacccacagaaaagcaaaataaccaactacctactcaattgtgtgtttgtaattgctttgagcagtctagtcaaatcatataaattgttctaaatttcagaattgaacattgaagtattaactcttctgttcacacatttagaattttagctcccaagatggtagggcagactgaccgtacagtaatttatttgtcgttagtgttaaagattaagcatagtaactgactcttaagtgttaaataatgtagaagtaaaaaaattttttttaaaggcttaatttgggaggggggacttatttctgtttacagtgtattaccttccttccctcctcttctccccccacacccaacaaaatacagtttggaattcactgaaacagtaccagcaagtcatgagattttttagtaaagatgagaaagatggttgaagaaaattagtgcataatttctcagtgaataaagttgtagctctcatatactaaatagacaagtttacatgctgttatttagaaaatgactaaaatattaaaaaccgtgttgtgttaatctgttttaagtcataccatgttcagagttctatgtaaggtgggttttatttttcttttaagggatagtttgtaatagtaagaactgtcccatatgttagtaaattacatatgtacaaattgaaactgtaaattgtgaacactggaaagcaccattgtgacatagagtaaacatcttagtaatatattaaagtgaatgtaaatggtggtt

SEQ ID NO: 147225 - DNA, 559 bp, Homo sapiens
  Payload ID: 9120
  Gene Symbol: LARP4
  Gene Name: La ribonucleoprotein domain family, member 4
  ENST ID: ENST00000517559
  CDS Start-End: 307-559
actttccgggccgtacacgccgcggaaccggcagataggctgacacagcacctgggccgagcaggcctgcagcttccctctgcgcgctcacaacactctaggaagctatgggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaattt

SEQ ID NO: 147226 - DNA, 2853 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000518444
  CDS Start-End: 83-2254
cttatcctagcaattggggcgcgggcctgtgagccagttggagttgcggcggcgggaacgattgggctgagcagaggacgacatgttgcttttcgtggaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactgaatgtaa

SEQ ID NO: 147227 - DNA, 2068 bp, Homo sapiens
  Payload ID: 9120
  Gene Symbol: LARP4
  Gene Name: La ribonucleoprotein domain family, member 4
  ENST ID: ENST00000520064
  CDS Start-End: 1-1476
gaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcatgttagtaaatgatttgaaaactg

SEQ ID NO: 147228 - DNA, 1577 bp, Homo sapiens
  Payload ID: 9120
  Gene Symbol: LARP4
  Gene Name: La ribonucleoprotein domain family, member 4
  Uniprot ID: Q71RC2
  ENST ID: ENST00000522085
  CDS Start-End: 104-1441
ggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttcagaa

SEQ ID NO: 147229 - DNA, 588 bp, Homo sapiens
  Payload ID: 9120
  Gene Symbol: LARP4
  Gene Name: La ribonucleoprotein domain family, member 4
  ENST ID: ENST00000523389
  CDS Start-End: 478-588
cgggcctgtgagccagttggagttgcggcggcgggaacgattgggctgagcagaggacgacatgttgcttttcgtggagatgacaaaaccgagccccagaggttaaagtaactttacttagtaaaagtaaagtagtttaactgggatttagatccaggtcatgctgatgtcaaatcatggacgggatgttagcaattcaggcctgtccgactccccagcatttatggggttaagtggcatgggatttctgtttctgatagtaaatagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttcc

SEQ ID NO: 147230 - DNA, 1578 bp, Homo sapiens
  Payload ID: 9120
  Gene Symbol: LARP4
  Gene Name: La ribonucleoprotein domain family, member 4
  ENST ID: ENST00000518561
  CDS Start-End: 315-1442
tgtgagccagttggagttgcggcggcgggaacgattgggctgagcagaggacgacatgttgcttttcgtggagcatttatggggttaagtggcatgggatttctgtttctgatagtaaatagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttcagaa

SEQ ID NO: 147231 - DNA, 584 bp, Homo sapiens
  Payload ID: 9120
  Gene Symbol: LARP4
  Gene Name: La ribonucleoprotein domain family, member 4
  ENST ID: ENST00000548174
  CDS Start-End: 238-584
gggtccactgccgggtggaggggcaaggcgagtgtgtgtccttatcctagcaattggggcgcgggcctgtgagccagttggagttgcggcggcgggaacgattgggctgagcagaggacgacatgttgcttttcgtggagatgacaaaaccgagccccagaggttaaagtaactttacttagtaaaagtaaagtagtttaactgggatttagatccaggtcatgctgatgtcaaatcatggacgggatgttagcaattcaggcctgtccgactccccagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 147232 - DNA, 790 bp, Homo sapiens
  Payload ID: 9120
  Gene Symbol: LARP4
  Gene Name: La ribonucleoprotein domain family, member 4
  ENST ID: ENST00000548993
  CDS Start-End: 415-790
ctgccgggtggaggggcaaggcgagtgtgtgtccttatcctagcaattggggcgcgggcctgtgagccagttggagttgcggcggcgggaacgattgggctgagcagaggacgacatgttgcttttcgtggagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtc

SEQ ID NO: 147233 - DNA, 722 bp, Homo sapiens
  Payload ID: 9120
  Gene Symbol: LARP4
  Gene Name: La ribonucleoprotein domain family, member 4
  ENST ID: ENST00000552445
  CDS Start-End: 540-722
gctcacaacactctaggaagctatgggaggtgaggcccgtagtggagaagaattgaaggagaaaaacggagggctgttctggtgtggcgcatttatggggttaagtggcatgggatttctgtttctgatagtaaatagacgggctcactttgttaccccggctggagtgcggtgtcacgatctcggctcactgtaacctccacctcccaggttcaagcattcctcctgtctcagctctccaagtggctgggactacagtgagaatcagagcgtctactgcacctttcagatgaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttt

SEQ ID NO: 147234 - DNA, 586 bp, Homo sapiens
  Payload ID: 9120
  Gene Symbol: LARP4
  Gene Name: La ribonucleoprotein domain family, member 4
  ENST ID: ENST00000551886
  CDS Start-End: 80-586
atcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 147235 - DNA, 567 bp, Homo sapiens
  Payload ID: 9120
  Gene Symbol: LARP4
  Gene Name: La ribonucleoprotein domain family, member 4
  ENST ID: ENST00000550522
  CDS Start-End: 399-567
attctcctgcctcagcctcccgagtagctgggactacaggcgcccgccaccacgcccggctaattttttgtatttttagtggagacaggggtttcaccgtgttagccaggatggtctcgatctcctgaccttgtaatacgcccgcctcggccccccaaaatgctgggattacaggcgtgagccaccgcgcccagccggtttcacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaat

SEQ ID NO: 147236 - DNA, 583 bp, Homo sapiens
  Payload ID: 9120
  Gene Symbol: LARP4
  Gene Name: La ribonucleoprotein domain family, member 4
  ENST ID: ENST00000550260
  CDS Start-End: 11-583
agaggacgacatgttgcttttcgtggaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgaga

SEQ ID NO: 147237 - DNA, 587 bp, Homo sapiens
  Payload ID: 9120
  Gene Symbol: LARP4
  Gene Name: La ribonucleoprotein domain family, member 4
  ENST ID: ENST00000548697
  CDS Start-End: 480-587
actgccgggtggaggggcaaggcgagtgtgtgtccttatcctagcaattggggcgcgggcctgtgagccagttggagttgcggcggcgggaacgattgggctgagcagaggacgacatgttgcttttcgtggagcatttatggggttaagtggcatgggatttctgtttctgatagtaaataggtaagcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtt

SEQ ID NO: 147238 - DNA, 1572 bp, Homo sapiens
  Payload ID: 9120
  Gene Symbol: LARP4
  Gene Name: La ribonucleoprotein domain family, member 4
  ENST ID: ENST00000616828
  CDS Start-End: 104-1228
ggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttc

SEQ ID NO: 147239 - DNA, 856 bp, Homo sapiens
  Payload ID: 9120
  Gene Symbol: LARP4
  Gene Name: La ribonucleoprotein domain family, member 4
  ENST ID: ENST00000615080
  CDS Start-End: 290-856
cttatcctagcaattggggcgcgggcctgtgagccagttggagttgcggcggcgggaacgattgggctgagcagaggacgacatgttgcttttcgtggaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacagcaatttattattaagagaagaagttaa

SEQ ID NO: 147240 - DNA, 1949 bp, Homo sapiens
  Payload ID: 9120
  Gene Symbol: LARP4
  Gene Name: La ribonucleoprotein domain family, member 4
  ENST ID: ENST00000614335
  CDS Start-End: 315-881
aggggcaaggcgagtgtgtgtccttatcctagcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaagg

SEQ ID NO: 147241 - DNA, 5642 bp, Homo sapiens
  Payload ID: 9121
  Gene Symbol: LARP4B
  Gene Name: La ribonucleoprotein domain family, member 4B
  Uniprot ID: Q92615
  ENST ID: ENST00000316157
  CDS Start-End: 42-2258
agcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaa

SEQ ID NO: 147242 - DNA, 681 bp, Homo sapiens
  Payload ID: 9121
  Gene Symbol: LARP4B
  Gene Name: La ribonucleoprotein domain family, member 4B
  ENST ID: ENST00000406525
  CDS Start-End: 288-681
ggaagaatccgccgccgccgccgccgccagctcgcgcccgccctctcccctacctccggcccggcccggcccggccgcgccgcctctccctgccgtctctctcctcgccgtccccgcgtgtggcgcggccgccgggccccggggttgaggcgaggagcccgcgggcggccggtcgggcggggcggcggcgctgacagagtcgtgtggaagcagggagtggtcacatgtgggtgttactgggcggcaagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccct

SEQ ID NO: 147243 - DNA, 432 bp, Homo sapiens
  Payload ID: 9121
  Gene Symbol: LARP4B
  Gene Name: La ribonucleoprotein domain family, member 4B
  ENST ID: ENST00000412411
  CDS Start-End: 262-432
tgtaaatgagaggaagcaaagatttttatggagactatcaataatctcaagaaaatacatattcaaaatggaattaaagccgtgcagtaagattgcatgtgaaacatcaacaggaagttgccttttcctcctctggactctgggtatactttgtttgccatctgcgagatcagtccatggctgagagatggcataagtgagcctgagtgcagcagtgagcagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaac

SEQ ID NO: 147244 - DNA, 1438 bp, Homo sapiens
  Payload ID: 9121
  Gene Symbol: LARP4B
  Gene Name: La ribonucleoprotein domain family, member 4B
  ENST ID: ENST00000448368
  CDS Start-End: 1-1018
ttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgt

SEQ ID NO: 147245 - DNA, 656 bp, Homo sapiens
  Payload ID: 9121
  Gene Symbol: LARP4B
  Gene Name: La ribonucleoprotein domain family, member 4B
  ENST ID: ENST00000440895
  CDS Start-End: 1-572
caagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggtgggtttttatttgcgtctgtctgtgttgtgttttctgtacaaaatacctttaatatttgctaataattttccactaactactctagttctttctcagaccaccatgtagtccttttatttcagtgttggtcaatagaggtttcttgagtagtaacaagaccccagctcctgtttctccatagactttaggatc

SEQ ID NO: 147246 - DNA, 613 bp, Homo sapiens
  Payload ID: 9121
  Gene Symbol: LARP4B
  Gene Name: La ribonucleoprotein domain family, member 4B
  ENST ID: ENST00000476529
  CDS Start-End: 113-352
gcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcagaaaacactcctcagctaccggtgtcagaggacggtgttgtttggggatggcatgatagagacggacagttcgtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacag

SEQ ID NO: 147247 - DNA, 8546 bp, Homo sapiens
  Payload ID: 9121
  Gene Symbol: LARP4B
  Gene Name: La ribonucleoprotein domain family, member 4B
  Uniprot ID: Q92615
  ENST ID: ENST00000612396
  CDS Start-End: 318-2534
gagctgtgtgttctcatgcgaacgggaaggagcgttggggatctggagtcccggggttgagacattttcgggcccgaaaggggaagaatccgccgccgccgccgccgccagctcgcgcccgccctctcccctacctccggcccggcccggcccggccgcgccgcctctccctgccgtctctctcctcgccgtccccgcgtgtggcgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaacgttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaatttttcttttgattttttttaaattaaaatttcttcaataatgcatcttttctaaacatagttttttgtctgttcccataagtgcatgagaaagaaacacgggcctcatatatgattggatcctaaagccttctcacctacgtgggggctggctgtggcacacggggctcaccctttgtgttttagtggttcagagtgagcattaacatcagatgctcatgcggagacagccattactgtgactgccaagatgtactgcaaaaatacatgttcctgtatcaggactttgattttgttaaaatggcactctctccaaagctgtgtccatgaagctgtttggagctaacgttgggtcttcatggtgatggactcatccttaggcagcagtgatgtctgcactaggaagaggctggcgggaggcggggcccctcctgtgccaggcaccgagtggatgggggactgattaacatgttgctgccttcctcctctgtgcattgccttttcatgtcgtcttcccatttttactctttttctgatggaattaatattcttgatctgttaaggctattaatcctttgtcatatatgttacaaatattttctttcaatctaccatttgtcttaactctttatttagaatagtatcttttacggtgtttaattattgtgtagtaaaatctatcaatcttctcctttgttgagtgtcttggacttgcttaagaagcctttccctactccagggtcataaagttaatagtgtgtgtgtatgtgtgcgtgtgtgtgtgtgtgtgcgtgcacacgcacacacacacacacacgcttttaatccagctgggcctaatcgtgtgtgtggtgtgcgtgcttaggcaggaacccagttttactttatgccatgtggaaagtttctttttccagtatcaccagtgagttcactgtctctccactggtctgcagtgctgcttctgttacttgcagacttcccacgtgtgcatggatctccacctggggtctctagggtctctattctacactgcctatttccctttctgtcctaacaccatagcatttaactcacccgtcatcctgtgttgctgagaatttccttcatagaactcatcaaagtatgattaactgtgctccctgagggcaggaattatgccatctggatcaccagcctctcccttgtccttagcacgccatctgcaaattagcagatactcggtaaatgtgtattaactcgaagtatattttgtgtcttctctgtgcacagcactgccctgggaagaactaggatgaggtattgacttgctgttgccacataacaaaccctgccagaactccctggatggaagtgaccaccgtgtatctgtggattgtctgcagggctctgctggggtcagcaggtcccacaagagagccagggctcggtctcctcatggctgtcagaggtttacgtattccgcctccacccaccaaagtctgaagttgttgtattccattccttgctatatccacatcttttaataatgctaaaatcccgtgtttctctaaagcattggattgaaccaactgaagaaggaccacgtgtgttgctgggcctgcttgggcacaagccgtttccgatccaagtcaactgctggtctgcttagacgaaggtgtgtgggtgtctccaccacggagaggagggacagcaggtgagaccataggccaggaaggaagggcacagcctaagcgtgcagtggcttagccagagaccctcgtgcaccagccttcaggtgcttatggaacttatgtcagcccaggccatatccaagtgtgtgatgtctcggagcatatatgccaggccagccggagaggcttagccctgccctggtggagctggagggccgcagggccgcccggtggggtcaggaggttgtgaagaggatcctgatacaggctgggcctccctgcaggcgtgagccccggagcacggggtgagcagctccacccagaggggcttgcaggaccaagctgggacagcaaccaccaggccctggggcagatcagtgagcgtccaggagatgcagatgcagaagacagccaaattcattcacctctgcgtgggcctgtgagggcccacagagatgcattttcattcacgaccaggatttcctcggccggagcagccgcttttcccagccgaagctcactgtgtttactacataggatgtgagtgtatagaaagactctctctaacgttagctacgcgtgcagaaatgtggggcgcttacaagtgtgggcagccgcagcctgttcctcacccctgtcctaacgggacatactccacgcatgcacatttaggatcaccgtgtcttctcgttggactgatctgtcattaggaccctggacccaagtaattgtctttgctctgaagttttgacagtaacaaaggcattccagctctttctttttcactcctgtcggtgtaacgtgccgtttttcatcctttgacttttagcccgcctgtgccctgtctgaagggagttgtctgtggacagcacggagtggtgggtgtttgtaatccactctgccagcctcagtcttctaactgttgcgtatggaccaattacatctgccctttctcttc

SEQ ID NO: 147248 - DNA, 1826 bp, Homo sapiens
  Payload ID: 9121
  Gene Symbol: LARP4B
  Gene Name: La ribonucleoprotein domain family, member 4B
  ENST ID: ENST00000614908
  CDS Start-End: 1-462
gtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaacccactgccctgggaagaactaggatgaggtattgacttgctgttgccacataacaaaccctgccagaactccctggatggaagtgaccaccgtgtatctgtggattgtctgcagggctctgctggggtcagcaggtcccacaagagagccagggctcggtctcctcatggctgtcagaggtttacgtattccgcctccacccaccaaagtctgaagttgttgtattccattccttgctatatccacatcttttaataatgctaaaatcccgtgtttctctaaagcattggattgaaccaactgaagaaggaccacgtgtgttgctgggcctgcttgggcacaagccgtttccgatccaagtcaactgctggtctgcttagacgaaggtgtgtgggtgtctccaccacggagaggagggacagcaggtgagaccataggccaggaaggaagggcacagcctaagcgtgcagtggcttagccagagaccctcgtgcaccagccttcaggtgcttatggaacttatgtcagcccaggccatatccaagtgtgtgatgtctcggagcatatatgccaggccagccggagaggcttagccctgccctggtggagctggagggccgcagggccgcccggtggggtcaggaggttgtgaagaggatcctgatacaggctgggcctccctgcaggcgtgagccccggagcacggggtgagcagctccacccagaggggcttgcaggaccaagctgggacagcaaccaccaggccctggggcagatcagtgagcgtccaggagatgcagatgcagaagacagccaaattcattcacctctgcgtgggcctgtgagggcccacagagatgcattttcattcacgaccaggatttcctcggccggagcagccgcttttcccagccgaagctcactgtgtttactacataggatgtgagtgtatagaaagactctctctaacgttagctacgcgtgcagaaatgtggggcgcttacaagtgtgggcagccgcagcctgttcctcacccctgtcctaacgggacatactccacgcatgcacatttaggatcaccgtgtcttctcgttggactgatctgtcattaggaccctggacccaagtaattgtctttgctctgaagttttgacagtaacaaaggcattccagctctttctttttcactcctgtcggtgtaacgtgccgtttttcatcctttgacttttagcccgcctgtgccctgtctgaagggagttgtctgtggacagcacggagtggtgggtgtttgtaatccactctgccagcctcagtcttctaactgttgcgtatggaccaattacatctgccctttctcttc

SEQ ID NO: 147249 - DNA, 4469 bp, Homo sapiens
  Payload ID: 9122
  Gene Symbol: LARP6
  Gene Name: La ribonucleoprotein domain family, member 6
  Uniprot ID: Q9BRS8
  ENST ID: ENST00000299213
  CDS Start-End: 72-1547
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctgactttgaggttatagattgtgcctgacaaaagtctgtgcctgtctgacagagctgtgggtggtatgtcatgaggccctgaggagcttagcagagacatctttcttttctttaagagaacatttaaaaatttttttatttgtacacatttatgggctacatgagaaactttgttacatgtttataatgcatagtgatcaagtcagggcatttagggtttctcactgtaccccagggcagccccagggctctccttgggcttctggcagcctgagtggtgtctcatcacagggaattttactgagcaaaggcagcttggcgtatactgagggtgtacagtccaggacccacagcattgatctcacctgggaacttattagaaatccagattctcaggccaaccctaggcccactgaattagaaagtctgggagaaaggcctggaatttgggttttaacaaacgctgcaggtgattctgatgcacgctggagaaccactggatggacaaaggctgcaggacttgaggtcagtccatttgacccccaatctctcactattttgtgaccttgggaaggttactaagccccgtgaacctcatcatctccctgtgaattgctttgttacgatgtccatgtctggaatgcagctggccctccataaatgttagctctctttccttctcacttgggttaatgtttgttatcatcaggagctgccttggtgtagcagaaagagcattggcctagattccagtgttggcttatgctctggctatttggcaggatttaatagagcttgttaataattattgaacagtgattaggtgccagggactatgctaagagctttccatgcattatctcatttaatctgcccaaaaactacaagagaaatgttcaggtattatctctattttattccagaaaaaaacagactttacttgggtaattaacttgtctaaggcttaacagctaaattggtagagttgggcttgaaactagtggtctggctttggagcccacactgtttaaccactaagtggtactcaacatttctgatctttactatccatattcaaaaaagaatccaccataaaaggtgctaatatttattcagcaccttcctacgtgctaggcattgggttagacacatttcacttactctcagtgtccatcataaggaattattatgccagtatcacacatgcagctgctgaagtaggaaaataatatcccaaacttgtgaaaatggacaaagatagtatatcctaaatgatatggctctatacaaattagcaggtgattgtgatctggatagtaagatgctttgtcccttaagatgcagaagagttcgtgttaactggcaaatgcctccagcaatgttctggatttgccatttccagcactaccagctgtaggtagcctgaaggcttgtgcctagaccaccaggactcctgaccttgggcaatgtcagggccccctccagccccgccctatgcttccctccctgactctgctcccatcaccccctgcctgctccttccctgcagccactccacctgctccttggccatcgggccatctgggcttcaccagctcttcttggcctgtgacattcaaggctgttccaccctattatgcctgttacacaagtcacagctctatttttagattaaccctcgtggatcatagttacttttaaaaatacctacaccctcacctttacatgtgaatacagatgaacttggccttcctttggtcgtattgccctgtgtgacattataaaagaaccctgaagtgggggtcagcagatctgaggtcgagtcgtggcttttctactaagcaactgtgaccttcagcaagtcatttattttattggttcacagttcttcccacaaaccagtggataacaagaagatgttccttaaataaggtcatatatgtgcaagtgctttctgaatggaaaagtgctttgcaggcattagtcactacttatcctgctgtctgatcatcacctccaaaggcaagcctccttttgctgcaattcttaaccctggcctcacattagagtcacctaaagagcttttaaaaactgcctatggggctgggcacggtggctcacgcctgtaatcccagcacttcaggagactgaggcgggcagatcatgaggtcaggagattgagactatcctggctaatgtggtaaaaccctgtctctactaaaaatacaaaaaaattagccgggcatggtggcacgcacctgtaatcccagctacttgggaggcggaggcaggagaattgcttgaacctgggaggcggaggttgcagtgagccgagatcacgccgctgcattccagcctgggcaacagaatgagactccatctcaaaaaaataaaaataaaaataaacaaa

SEQ ID NO: 147250 - DNA, 527 bp, Homo sapiens
  Payload ID: 9122
  Gene Symbol: LARP6
  Gene Name: La ribonucleoprotein domain family, member 6
  Uniprot ID: Q9BRS8
  ENST ID: ENST00000344870
  CDS Start-End: 34-315
gaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaa

SEQ ID NO: 147251 - DNA, 964 bp, Homo sapiens
  Payload ID: 9122
  Gene Symbol: LARP6
  Gene Name: La ribonucleoprotein domain family, member 6
  ENST ID: ENST00000559140
  CDS Start-End: 1-235
cgtggacgagttggaggacgaggaggagggggcggagactcggggcgccggggacccggcccggtacctcagccccggctggggcagcgcgagcgaggaggagccgagccgcgggcacagaactgcccagctcccgtggcttgagtctcagcaagtgttcagtctgaagcccttcctgctgcccactggcatagagttgaccccagaaaatccctggggttcttcggtgagctgacagagcccagtgggcaggcacccagagcaggaggagatgtagccaagaacaggatccacactatcccctgtttggacccaggctcgcatggcagcagccatcacccgatgtgaatgttctcagctcctggagcctacaggagaaaacccagattcctcaatctgctcattaagatgtgacacccactcacatcatctcctcagcccattgcctcaacagttcacgctgtcaacagttcacgctcccgtgattccagctagttccctgagcatagggggctattttgtgtctacatgcctctgcacccccacctctaggtcctctgattgactgatttctagtcagcctttaaaacttcgctgcctcttctccaccacccccaatccccaccccagagctggctgtgtttcctttcttctctgttgctgtagtactctgtacattttatgcctagcaccttccacaattgtgattctatcattgtgtctccctcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatac

SEQ ID NO: 147252 - DNA, 558 bp, Homo sapiens
  Payload ID: 9122
  Gene Symbol: LARP6
  Gene Name: La ribonucleoprotein domain family, member 6
  ENST ID: ENST00000559316
  CDS Start-End: 465-558
atcatcgccctgcctttcccagtcctgctggctgcgctcagtctttaggtggtagcaggccaggtacagcggacacttgctgatgggggattccaggaggtgggatttcaagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaac

SEQ ID NO: 147253 - DNA, 2164 bp, Homo sapiens
  Payload ID: 9123
  Gene Symbol: LARP7
  Gene Name: La ribonucleoprotein domain family, member 7
  Uniprot ID: Q4G0J3
  ENST ID: ENST00000324052
  CDS Start-End: 151-1899
ggggcccggcgtggggaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacattatttgga

SEQ ID NO: 147254 - DNA, 2286 bp, Homo sapiens
  Payload ID: 9123
  Gene Symbol: LARP7
  Gene Name: La ribonucleoprotein domain family, member 7
  Uniprot ID: Q4G0J3
  ENST ID: ENST00000344442
  CDS Start-End: 279-2027
aagccaaaaaccgccgctttcaaatcgccaatcaaattcttccttggcttcgagtctctcagccggccgcgctctccgatgcccagccctcctggaaccacctcgcctgtgacgtaggtggagcgcgcactgcctccgggcccgtctttctcaattgggaccggaaaacgttgtcgctcatcctatgacgcgaaagtaaccgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 147255 - DNA, 1047 bp, Homo sapiens
  Payload ID: 9123
  Gene Symbol: LARP7
  Gene Name: La ribonucleoprotein domain family, member 7
  ENST ID: ENST00000505034
  CDS Start-End: 151-1047
ggggcccggcgtggggaggtttggggcgcgcccggcctatgacggcgtccttgcggaagtacgggtgccgagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagc

SEQ ID NO: 147256 - DNA, 753 bp, Homo sapiens
  Payload ID: 9123
  Gene Symbol: LARP7
  Gene Name: La ribonucleoprotein domain family, member 7
  ENST ID: ENST00000507443
  CDS Start-End: 367-753
gatggagaggagggggtgttgcgatggagagtgtccacgtcccttaatcttacacttttcacttactgacttaaaagtgcagcttagtgagataaaggtgtaattttttatattattctaggataatctggccctgtgttttaaaaggtacaaagaaactaaagctatgatccctaacatagaaggtaaattatttttaaatttaatttattaaatataaaaatgaatgttctttctgtttgtcttctgatggccaaatgtgagtccattattctctcagacagttaaaggctaatctaaatatttaactatattagctattgtggtgatttaaatatttacatctttttcttgtaattcacaggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtg

SEQ ID NO: 147257 - DNA, 528 bp, Homo sapiens
  Payload ID: 9123
  Gene Symbol: LARP7
  Gene Name: La ribonucleoprotein domain family, member 7
  ENST ID: ENST00000513553
  CDS Start-End: 62-528
ggagacggaaatgtccgaaggccgcagtacttgaccctgtattttgggagtcgaacggagaatggaaactgaaagtggaaatcaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctaga

SEQ ID NO: 147258 - DNA, 2020 bp, Homo sapiens
  Payload ID: 9123
  Gene Symbol: LARP7
  Gene Name: La ribonucleoprotein domain family, member 7
  ENST ID: ENST00000509622
  CDS Start-End: 116-253
gaaaacgttgtcgctcatcctatgacgcgaaagtaaccgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacagatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 147259 - DNA, 2332 bp, Homo sapiens
  Payload ID: 9123
  Gene Symbol: LARP7
  Gene Name: La ribonucleoprotein domain family, member 7
  Uniprot ID: Q4G0J3
  ENST ID: ENST00000509061
  CDS Start-End: 304-2073
ggaaaacgttgtcgctcatcctatgacgcgaaagtaaccgagactatcaggatccggagacggaaatgtccgaaggccgcagtacttgaccctgtattttgggagtcgaacggagactctgccatcgtcctcaaagagtaaaaaatccagttacggaagggaactaacacttgctagatatggtgtgcagagtgcgtttgcaaagaaacttaagagaaaacaaatgataggacacagggtggtggaagatctcaaagagataatctggccctgtgttttaaaaggtacaaagaaactaaagctatgatccctaacatagaaggaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtggaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 147260 - DNA, 477 bp, Homo sapiens
  Payload ID: 9123
  Gene Symbol: LARP7
  Gene Name: La ribonucleoprotein domain family, member 7
  ENST ID: ENST00000505216
  CDS Start-End: 82-219
gagagaagcagtagtcaataaagagagtgccgtatttcgcagattggagctgagctgtggctgccagaagatagcgaacgaatggaaactgaaagtggaaatcaggaaaaggtaatggaagaagaaagcactgaaaagaaaaaagaagttgaaaaaaagaaacggtcacgagttaaacagatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaaaggatgaggatgaacgcacagtgtatgtggagttacttcccaaaaatgttaatcacagctggattgaaagagtatttgggaaatgtggcaatgttgtttatataagtataccacattataagtctactggagatccaaagg

SEQ ID NO: 147261 - DNA, 1003 bp, Homo sapiens
  Payload ID: 9123
  Gene Symbol: LARP7
  Gene Name: La ribonucleoprotein domain family, member 7
  ENST ID: ENST00000511529
  CDS Start-End: 1-1003
agaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagagccccatgtcttaacggagagcttttttatttatttcaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagaca

SEQ ID NO: 147262 - DNA, 579 bp, Homo sapiens
  Payload ID: 9123
  Gene Symbol: LARP7
  Gene Name: La ribonucleoprotein domain family, member 7
  ENST ID: ENST00000508577
  CDS Start-End: 222-579
gagactatcaggatccggagacggaaatgtccgaaggccgcagtacttgaccctgtattttgggagtcgaacggagactctgccatcgtcctcaaagagtaaaaaatccagttacggaagggaactaacacttgctagatatggtgtgcagagtgcgtttgcaaagaaacttaagagaaaacaaatgataggacacagggtggtggaagatctcaaagagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatatgttgatatatcactacttgtgtcttttaacaaaatgaaaaaattgactactgatgggaagttaattgccagagcattgagaagttcagctgttgtagagcttgatttggaaggcaccagaatccggaggaaaaaacctctgggggaaagaccaa

SEQ ID NO: 147263 - DNA, 556 bp, Homo sapiens
  Payload ID: 9123
  Gene Symbol: LARP7
  Gene Name: La ribonucleoprotein domain family, member 7
  ENST ID: ENST00000512589
  CDS Start-End: 136-441
gtctttctcaattgggaccggaaaacgttgtcgctcatcctatgacgcgaaagtaaccgagactatcaggatccggagacggaaatgtccgaaggccgcagtacttgaccctgtattttgggagtcgaacggagaatggaaactgaaagtggaaatcaggaaaaggtaatggaagaagaaagcactgaaaagaaaaaagaagttgaaaaaaagaaacggtcacgagttaaacaggtgcttgcagatattgctaagcaagtggacttctggtttggggatgcaaatcttcacaaggatagatttcttcgagaacagatagaaaaatctagagatggatgcaggaatgcactggctccatgtctgctcactccaacttctgcccccacctccaccccctcagccccacccaagcgatcctccatcagcctccccagtagctgagaacacagatgttgatatatcactacttgtgtcttttaacaaaatgaaaaaattgactactgatgggaagttaattgccagagcattgagaagttcagctgttgtagagcttgat

SEQ ID NO: 147264 - DNA, 560 bp, Homo sapiens
  Payload ID: 9124
  Gene Symbol:
  Gene Name: LA16c-306E5.2
  ENST ID: ENST00000575785
  CDS Start-End: 84-374
aacagcttccggcgtgacgcagtagaaaaggtggcgtggctggcgattcgtgttcgtgagggccttttctggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattg

SEQ ID NO: 147265 - DNA, 2905 bp, Homo sapiens
  Payload ID: 9124
  Gene Symbol:
  Gene Name: LA16c-306E5.2
  ENST ID: ENST00000618352
  CDS Start-End: 797-1132
agaaattagtaatgtttataaatttgtttatagtagtttgtaaattattatcagaaatagtaatgtctataaaccacttactttaagagacaatcaggaactatgatgagggcaataataaaaggagaaatcttacaaaaaattaacctggatgttgtgcttgctctaaggttaagtcacttagggaaacagattcagtattatccaatggcttaaccatccttccttctttctgtttgctttttggtggtggctgggttacaaagagcagtgtcttctgccctgaaggtagcagtattacggtgggtgcctagaggtcaattattggtttagaagagattcaggcccttaacttttacatgtgctttccaggaaaggagacactttctttctcagccctgtgtgaggactatgttagcccagaaagtgttcttggaccactgggtgcccattctcagtgctaggaacaggaagaccctggtttcctggtagaatttatggatcctacagctttctctccatcaaactttaagtcacagtaagataggactctggagtcacaggcacagccaggagaggtcagcgtccttatgctgactcctggtcctagacatgggtcttaagatccagtagtcagtaggtctgttgcaaagtcagggactggctagatctctccacagcagaagaaagctcatacatgctgacctgaggaacttaatctgacagtttaccgacacactcataacgcatctcttccttcctgtgatgagagtactgctttcatgtgtactgtctgatgacgggtgagggcagagttcttagtgaagcctctctcacagtgagaacacctgtaaggcttttcaccagtgtgggtttttcggtgggcactgaagtgggagctattgttgaagattttcccacacactgcacacttgtatgggctctccccagtgtggatgcgccggtgagcactgaactgggaactgttgttgaatctctttccacagacaatgcactggtaaggcttttccccggtatgggtcctctggtggacaatgaggctggaactctggttgaagcttttcccacattgcccacactgatagggcctctcccctgtgtgagttcgtaggtgggcagtgaggttggagcgctcactaaagcccttcccgcactcactgcacttgtgaggcttctcgcctgtgtggattctttgatgccgaacaagataagaacttcggctaaaggttttcccacattcaggacattgagatactttttccagtttgagcgctggcttgtggggagagtgcacactctgagagcagtttttcccacagaggatatgtgtacaggctttgtccctggcacaaaaactctggtgactcatcttctcctgggatggggttttctcctcactctcccctggagaatttctacattgccttcttgatgttggctcactctccaagcctttttgtagctcagagtgccaataaactcctctggactttctctgtaaagccttgtttatttctacttcctctgaatcatcccattttagattttcttttttaatctcgttcttgaactcaaaaccaagtctgtttgggaacagcactggcaggtctagtttcctgacttcctggccaggattcctgaagtccttttcatccctgtctgcaccatccacagtgccatcttctacctccgtgggttccccattctggtgattcagctctccagcctcaatatcacttccttcttggccaggaacagcatcgcttgccataggaggtgcagaggcccaggagcctgaaagagcattcatttcctcataaaagatacaaggctcaggcacacggcctctcctcactttgcggtaactcaactgtaggcttttgaacttggtgcgacactgttctggggtccgcagaaaaccctgctcccagagtccttccgccatggccctgtagatctggctgttctgctgacaggtctggagttttccataaaattgagaactactaagaatagccaggagcgtcttggtctcttcatagccccagggcacacctgttgccagcgagacgtgactgtccttcctctgggtggcacccctgtagagggccctttgtgcagggcctgggcacatccattcttgctgacagagggatacagctctgttgtcacgcatggctggtccctgtaacaacactggagctgctgctaccgataaaatagcaccactctagcctgggacccagctgtccagaccacagcacctgtctcctggtcgtggagacctgtgttttgaggcaggttcctgggagcctgaggagcaagccaggctgttgtccaggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtc

SEQ ID NO: 147266 - DNA, 2062 bp, Homo sapiens
  Payload ID: 9125
  Gene Symbol:
  Gene Name: LA16c-380H5.3
  ENST ID: ENST00000573315
  CDS Start-End: 22-1632
cctcccactctgcctagagtcatgggcgcctgggccttccccgcagcccttttccttctctgcctgacttccgagagcctgcaaggtgggctgccccttctgcctcctggcctggggaaagtctatggcccccacagtggcctgggagcaggctatgatgggggcgtgaagccacagaagccaggattcgtggtcaggcatgggctgggaacccagccagacactgaagggggcatgaaaccccaaaacctagggttcaggaccttcgcaggtgctgcagcccagccaggatatggaaacgggctgggagcagcggccttcccagtggccggagcccagtcaggtcctgccgctcaaaatggctttggaccaggctttggagggggtggaaaaccccagaagccaggccccaccactcaaaatggctatagaccaggctatgtgggggccgtcaaaccccagaagccaggattccagtacagaattgggctgggagcccagccaggctttagaggggacatgaaggcacaggagccaggattagggaatgggaatgggctgagtgctcagccagtcttgacagcccagaaccgatttggatttggagcaggccttggagggaatgtgaagcctctgaagccaggatatgggaaaaggctgagagcaggggccttccctggggctggaacccagccagaatatggccatggaaatggaccgggagtccagccaggcctaggagcggggatgaagcctcagatgccaggcctgggagctccaaacggctatggaccaggaaggggcagggctggggttccaggaggtccagagcggaggccttgggtccctcacttgctccctttctcttcaccaggctatttgggggttatgaaggcccagaagccaggccccttagcccagaatggctacagagcaggtgctggagagggcatgaaacctcagaagccaggcctgcgagggaccttgaagcctcagaagtcaggacacggccatgaaaatgggccctggccaggtccctgcaatgcgagggtcgctccgatgctcctccccaggcttcccactccaggggtcccttcggacaaagagggtggctggggcctgaaatcccagcccccttccgcagtgcagaatggcaagttaccagcaccaatgccagccatccagtggggactgaaacctcagaaagcagggcaccagcctccaaatggctatggaccgggagcagaaccaggttttaatggtggcctcgagccacagaaaattggtttaggttatgggaatggtgtcctgggagccagggtcttccccgaggcccacccacagccagggttccatggggccaatggttttaggaatagggatggggtggaagctctggtgtaccccaaagcagcagctctagcccctgaaggaaatgggcaggccggggtgctgtggaactctcgctggcccaccctccaggcctggggggccggcttgaagcctggatatcaggctggagatgaatatgctgaggccaggagccagccagggggccccgacgtgaagagaggcagcaatggccagctggggaatggctacggaggccgctgccctctggggaaatgctgagcactgcaatgcccctcgcctgcccagcaaggaagacagacccttgggcttggcctctggtgctgcctggccgggggtctcctccatgctagaaccacaaacgtgcttccctgcttgcctccgcgtgccatgcaaggggcttgctgaccagggtgggagtggcatgggcctgcagccaccacccagcacctcattcattcatttggcaaacatcaatgaggccatgtgccagggaccatgttcccaacaggagaaatcatgagaagaaaacagactcgatcaacgcctgccctcagggagggcatcacttggtgaccgcctagcgggggaaccacatccaagttaggggccttgtgcatggaaaagaacacttcattctttgtgttttcatttataatcgatttattaaagttgttagataaaaatctca

SEQ ID NO: 147267 - DNA, 5326 bp, Homo sapiens
  Payload ID: 9126
  Gene Symbol:
  Gene Name: LA16c-431H6.6
  ENST ID: ENST00000454337
  CDS Start-End: 1-367
caagaagaaaggcaagccagcaagcatggtgaagaacaaggagcaggtccgccacttctactaccgcacctggcacaagatcaccaagtacatcgactttgatcatgtgttctctcgaggcctgaagaagtcatcccaggaactgtatggcctgatctgctatggcgagctgcgcaagaagattgggggctgtatggatgacaagaatgcaacaaagctgaatgaactcattcaggttggacggagtttcaccatgttggccaggctggtcttgaactctcgacctcaggaaacctgtcaagggccaccactgtacgttacaaagggcggaacctgcggatcaaagcgcccatgtgccgggccctgaagaagctgtgcgatccagatggcttgagtgatgaagaggaccagaagccagtgcgcctgcctctgaaagtccctatagagctacagccgcggaacaaccacgcctgggcccgtgtgcagagccttgcccagaacccacgcctcaggatgatcgtggagctacatcgaaaggtctccagcctcatcgaattcttgaagcagaagtgggcgctccatgaggtgcgagttcggaagacactcgaggagcggcagctgcaggactcatgctccgcaccgatgcaggagaagacttggcagatgcacctgcggaggagctccaggagaaggggagccccgcggggcctccgccgtctcagggacagcctgccgccaggcccccgaaggaggtccccgccagccggctggctcagcagctccgtgaggagggctggaacctgcagacctccgaaagcctcacgctggccgaagtctacctcatgatgggcaagcccagcaagctgcagctggagtacgactggctggggcccggccgccaggacccccgccccggctccctacccaccgccctccacaagcagcgcctcctcagctgcctcctgaagctcatttccaccgaggtcaaccccaagctggctctggaagcaaacaccatctctacagcctcagtaaggcccgcccaggaggagcagtcgatgacgcccccagggaaggtggtgaccgtcagctctcgcagcccccgctgccctcggaaccaggcctccctccgcagcagcaagaccttcccgcccagctctgcaccctgctcctcaggtttgagaaaccctccaagacccctcttggtgcctggtccctccagcacaggaagcaatgactcagatggaggcctttttgctgtcccgacaaccttgccacccaacagccgacacgggaagctcttctctcccagtaaagaagcagagctgactttccgccagcatctgaactccatcagtatgcagtcggatttcttcctgccaaagccccggaagctgcggaaccggcacctgcggaagccactggtggtccagagaacactgctccctagaccatcggaaaaccagtcccacaacgtttgttccttctccatcctgtctaactcttccgtaactgggagaggttcgttccggcccatccagtcttctctgaccaaagcagctctgtctcggccgatcgtgcccaaggtccttccaccccaggccacgagtcacctggccagtgctatcgacttagcagctacaagtgccggcatcctttccgggaaccccctccctgccttggacaccgagggcttgtctggcatctctccactgtcttcagacgaggtgacgggtgccatctcggggcaggactctactggaactcaccaggatggagacaccctccccaccgtggggggctccgacccatttgtcagcatcccttcgaggcctgagcaggagccagtggcagacagtttccagggctcatctgttctctccttatctgagctgcccaaggcccctctccagaatggcctctccataccgctgtcctcgtcagagagctccagcacccggctgtctccaccagacgtctctgctctgctcgacatctccctgcccggcccacctgaggatgcgctgtcacagggcgagcctgccacacacattagcgactccatcattgagatcgccatcagctccggtgaaggagtccctctttctccagcaaaactgaatggcagtgacagttccaagagccttccctccccgtccagcagcccccagccacactggatcgcctctcccacccacgacccccagtggtaccccagtgactccaccgactcctcgctcagcagcctgtttgcaagcttcatctccccagagaagagccggaagatgttgccgactcccattgggaccaacagtggcacttccttgcttggccccagcttgttggatggaaactcgcgggactcatttgtgtccaggtccctggctgacgttgcagaggttgtggattcccagctggtgtgcatgatgaacgaaaacagcattgattacatttctcggttcaatgacctggcccaagagctgtccatcgctgagcctggccgccgagaagctctgtttgatggtggtggaggcggccccgctgtcagtgacctgtcccagtgaccacacgtcctggtggcggatgaagccctcttcgagctagagaaaaatagataagcccagcagccccagaagatggtctgaacagaggcatctccgcacccaagactgtgcaacgggcaggaacgtggtcacagagctgcttccccacgagcagcaggcaacggcgtccaaggagactaggatgagttcttggcaagggccagcgttagaaatcactgtggtactagagccgttcttcaccacgcctgggcccatgttagggtctgcataatgatcccatttcagcctgtgctctgcctcgattgttgtgttggacattccggtggcatttccttctgagacaagggagtatgtgtgccttggtgtagttgctgtgcactaggagctgtgatctccctctctgcagggaggccccagcccctgctgcttgctttctgccaaacctgtgctatgcatcagctgtgccctctgtggactgtaacgggcaggacagttgggtgtggcctgggctcatgcctggtggtgtcacatcccaaggcagcaagagcatggataccgatcacagggctgctgcggagtcgtggggccctgggctggtgcctcccctccctagaggttttgttcgtactcttaacagggagtgggggcaggaagagtcctgtactatgcaggttgtgtggactttacatgggaccctgctaagctggttgaaaatgtttttcttgtgttttaagaattaggagacatggaagaggaagaacaaagtcccctctgtagttggtttccttcctgtgtccctttgcaagcttccaggcgatctaaggtgtcatttctccctcctggggtgacccttaggcgctaatatgattacagcgaagactttcctgataagttctcaaactcgatgtgtgactgtttggcacttgagacaaacctgcctttgcagggaaagtgtctctcacgggcattggtgtgggcgtgcctgacatacgtgttcagtcccttgcatacctttgccttgagacttctgtgtctccttcccatttgggacacccaggtgagggcccagacatctggatgtggtcagacctcaccaaatatatgccttcgtggtggtctccctccttgcgccctcttgggtggccagcgttcctactgcagacggcccaacatccagtctttccccaggacagagctaacaagggcccctttgccttctcatcctcaggagttccaggcacatgagtcaccgtccatccacatccagtgtggcctggagctgctacagaggtgttgggcaggccatgcctgtgccgccatctctcccttcctgcctcatttcatcccccgcagcagccgggattgattgtgctttcctaacccccttggacctactctccctcctccccaccattcctcttcccccacatgtgtggcacgctgcagccctcaaggccagccctggcccctccactgcttctctccccatccacaatggagaaggtgaaaagaggagggaaaggcctttggtgtggacaagcatgtggacgccctccgtcctgcagtcttgccagcccaccacagccactgtagaccacaggcaggccgtgtactgcaccactgggaggacgtggagaggacagtgaacttccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccaggtgacttgagtagtcttgaattctccatctgttctggagactttggttgaatacaggcactgaggacacaaaagtggacgggggcttctggttcctgccagggagctgctcccaattgttccacggacccccatgagattcctgaaattgcgtgcaaattattgtgcatttaaacatttttcctagggagggagagtgtttttattcagatcgtcagtgggattgaaactcttaacaaggaagaattgatctagcacacatctacatagttcttcagtatttacccaacctcctagtggttacagtaggagggactctttgaaaaaggtttcttggccaggcgcggtggctcatgcctgtaatcccagcactttgggaggccaaggtgtgcagatcacgaggtcaggagatcgagaccatcctggctaacacagtgaaaccccatctctactaaaaaagaaaaaaaattagccgggcgtggtggcgggcacctgtagtcccagctactcaggaggctgaggcaggagaatggcatgaacccaggaggcggagcttgcagtgagccgggatcgcaccactgcattctagcctgggtgacagagcgagactccgtctcaaaaaaaaaaagaaaaagaaaaagaaaaaggtttctcagccgggcgtggtggctcatgcctgtaatcctagcactttgggaggccaaggcaggtgatcatgaggtcaagagtttgagaccagcctggccgacatggcaaaactccatctgtactaaaaatacaaaaattagctgggtgtggtggtgcacgcctataatcccagctactcaggaggctgaggcaggagaatcacttgaacccgggaggtggaggtggcagtgagccaaattcatgccactgcactccagcctgggtgacagctagactccatctcaaaaagaaaaaaaaaaaaaaatagaaaaa

SEQ ID NO: 147268 - DNA, 4099 bp, Homo sapiens
  Payload ID: 9127
  Gene Symbol: LACC1
  Gene Name: laccase (multicopper oxidoreductase) domain containing 1
  Uniprot ID: Q8IV20
  ENST ID: ENST00000325686
  CDS Start-End: 322-1614
aggtgaggcggggcgggtgtcgtcgcgctgggccgagcttacgactccagctgacccgctcgcggctgcccaatttcgttgaggctcaggacgagggacggggcggcaaattgtcacagaggtcgccgtagaccggtgtgcaaccgaaggtgaagagcgggaaggcgaggaccgaatcgcctctggtgtgcgttgtccgacaggaagtcccgaatgggctgtgagccgccggtggaggtgcccgggcaggtgcagagccacagcctgcgccccgtgagccgaggcgggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaatagaaacatttttgagaagtctgccagcactgagaggaaaattaactattatcacttcttctttgatcccagatattttcatacatggatttactacaagaacaggtgggatatcttatataccaactcttagctcattcaatctcttcagtagttccaaacggagagatcccaaggtagtggttcaagaaaatctgcgtaggttggcgaatgctgcaggatttaatgtggagaaattttaccgaataaagactcatcattccaatgacatctggattatgggaagaaaggagcctgactcttatgatggaataaccacaaatcagagaggagtcacaatagcagctcttggtgcagactgtataccgatagtttttgcagatccagtcaaaaaagcatgtggggttgctcacgctggttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagataagaggcgatcaaaatatttcaaaaagaaataatgaagatccaatgaaggaagtggaaattaaaatagggaagagagtagatggattagagagacatttaagagatggaatcaatagatcctgttactagataatggaagtaagaggtgaggaagagtggaaaagtcattaatgactctaagatttctgcttggctgcttaccaagattggcaacaaagggagggagaaggtttggaaaaagagagaaggataatgagtttgactttacatagaatgaagggcatccagatagaaatctttggttaataattagaaatatagacctagaaattaggaggaaacctgagacagagacaaatatttcaaagcttacaatacagagatgatacctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttagttttcatttgggaaaaattgtatatatatttaatgtaagttatcacattgcatcttaaaaatattcttatttaatacatatatttcctacatgtatatgtggtagcatgatagcaaataacatttgtttggtatttccaaaggactttcatgtacattgcctcattttacctttacagctactctgaaatacacaggcattatcccttttattcagctgagaaaactgagcttcattgaggtggaggtcaaaaatcacaaaatttgtgatgaattaagatttgaacatatgttttgtgactccagttttcctttcagattttaaaattaattaaagggatcttcattatacttttattgttaactttttgttaacataatttattcatacattcagtgaaaattttgttgaggtactgggacaggttaaaaaatacagttgtagccctcaggatatttaatatccagtgaaaagtgacagtcagtaaaccaacaatctcaatactttgatatatgttgtgaggttgtgataaccgattcttgtttagtttaattctatatctcccttagaccagtgttaaatttaaataaaacacctcattttttccaattcagggaaggcactaaacataaagcataggatagaaatgttgaactcatccaaaatattattttgtttaatgaaaatgatgaagattaaggaatacttccatgtattgagtaaggttgataattttctaattcttcactgtgcattattttgtttgaagttggtaaatttggagtatcctgcagacacattttgctttatgtactacaacattctacaaccaaataaaaattattttgattatctga

SEQ ID NO: 147269 - DNA, 4262 bp, Homo sapiens
  Payload ID: 9127
  Gene Symbol: LACC1
  Gene Name: laccase (multicopper oxidoreductase) domain containing 1
  Uniprot ID: Q8IV20
  ENST ID: ENST00000441843
  CDS Start-End: 486-1778
agacctgcagctcctgccgccctgcgcccgctcccagggcccgtcgttccgccgccctatccctcctcaaggggcccctagctgcctcctcgcgaccctttccggactcggcctgcccactcctgcccgctaacccgcctggctcccgggcgagagccctcgcgcggctctggttcctgttcctctaacgccgccggggctgcgggatgccgactccgcggaccgcccagacccggaactgctgaggcagcagcgggctcgcggcgcttggctcatcccgggattccccagctctcgcgctgggcccgccgcgttcgcaccaagcacgccaggcggccctggcctacctccctcccgcctcccggcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaatagaaacatttttgagaagtctgccagcactgagaggaaaattaactattatcacttcttctttgatcccagatattttcatacatggatttactacaagaacaggtgggatatcttatataccaactcttagctcattcaatctcttcagtagttccaaacggagagatcccaaggtagtggttcaagaaaatctgcgtaggttggcgaatgctgcaggatttaatgtggagaaattttaccgaataaagactcatcattccaatgacatctggattatgggaagaaaggagcctgactcttatgatggaataaccacaaatcagagaggagtcacaatagcagctcttggtgcagactgtataccgatagtttttgcagatccagtcaaaaaagcatgtggggttgctcacgctggttggaaaggtactttgttgggtgttgctatggctacagtgaatgctatgatagcagaatatggctgcagtttggaagacattgttgttgtacttggaccttcagtaggaccttgctgttttactcttccaagggaatcagcagaggcatttcataatcttcatcctgcatgtgtacaactatttgattcaccaaatccctgtatcgacatccgtaaagccacaaggattcttctagaacagggaggaattcttccacagaatattcaggaccagaaccaagatctcaacctctgtacatcttgccatcctgacaagtttttctcccatgtccgagatggccttaattttggtacacagattggcttcatatcaattaaagaatgagatacttgactggatttttgtataactgcttcctgcctccttccaaactgactgcaagagagaaatttagctgtttgatttacttaaaaccaaatggattacaatggataattcatcttttgggtatatttttactattattcaaagccaaatgattttcatttaattgtaataataactgacaaaaatcagtatgttgtagctaatatgttttatgcatgagaattattcttaaagtttgttctccctgtttattacacagatcaggaatagatttgttcagttcagtatttattggataccctctattggtcaggcattgtgttaagcatatgtgaatcaaaatgaacacaactttttcctttgagtctgatacagtgaaggagataaacacttctacaacttaaatttaattttaatagcagtagaagagaacataaggaatagaggttaattttacccagaagcaggatagagaaaatattacagagaaaatcacatatcacatgggctcgaaagatgtagaggtttttgacaaatgaagaacaaccataacaggtagagggaacaccatgaaccagggcatgaaactgaaagtgcataacatattctagagagagaagggtgtgggcatgagttagggctggaaaaacaggttggaaacagataagtaagggtctcaaatgcaatgtcaaagagcttgcagtttattttccaggcaatgagtaggcagccaaaaaaaaaaaagtaaggatgttttttttttttttcccatggcatcatatttaagaggatggatttaaattgtgtgagaccaaagcatagagactagataagaggcgatcaaaatatttcaaaaagaaataatgaagatccaatgaaggaagtggaaattaaaatagggaagagagtagatggattagagagacatttaagagatggaatcaatagatcctgttactagataatggaagtaagaggtgaggaagagtggaaaagtcattaatgactctaagatttctgcttggctgcttaccaagattggcaacaaagggagggagaaggtttggaaaaagagagaaggataatgagtttgactttacatagaatgaagggcatccagatagaaatctttggttaataattagaaatatagacctagaaattaggaggaaacctgagacagagacaaatatttcaaagcttacaatacagagatgatacctgattctattggagcaggtttgatcatctaggcagaaattaggatgagaaaaaaggagatccaataatacaaccttatagtcacagaagtaagaaaaaaagggtagttgttttgaagaagccaggataggtgtggaaagtactcaaaaagaaatcttcagggataaaataaagtgataatttaaaagaaatcaatggattaaacatattgaaactgttctataggcagtggtcattgagtcagctttcagtgcattaggaagaagatgcataggtgtcaactcttttctgacagcatttactagagaagagaaaaagctggggactacatcttcaaggaagggactttttttggatgagcagttttgagtgtgtttgtcagttaaagagaggaattaggttagttttcatttgggaaaaattgtatatatatttaatgtaagttatcacattgcatcttaaaaatattcttatttaatacatatatttcctacatgtatatgtggtagcatgatagcaaataacatttgtttggtatttccaaaggactttcatgtacattgcctcattttacctttacagctactctgaaatacacaggcattatcccttttattcagctgagaaaactgagcttcattgaggtggaggtcaaaaatcacaaaatttgtgatgaattaagatttgaacatatgttttgtgactccagttttcctttcagattttaaaattaattaaagggatcttcattatacttttattgttaactttttgttaacataatttattcatacattcagtgaaaattttgttgaggtactgggacaggttaaaaaatacagttgtagccctcaggatatttaatatccagtgaaaagtgacagtcagtaaaccaacaatctcaatactttgatatatgttgtgaggttgtgataaccgattcttgtttagtttaattctatatctcccttagaccagtgttaaatttaaataaaacacctcattttttccaattcagggaaggcactaaacataaagcataggatagaaatgttgaactcatccaaaatattattttgtttaatgaaaatgatgaagattaaggaatacttccatgtattgagtaaggttgataattttctaattcttcactgtgcattattttgtttgaagttggtaaatttggagtatcctgcagacacattttgctttatgtactacaacattctacaaccaaataaaaattattttgattatctg

SEQ ID NO: 147270 - DNA, 705 bp, Homo sapiens
  Payload ID: 9127
  Gene Symbol: LACC1
  Gene Name: laccase (multicopper oxidoreductase) domain containing 1
  ENST ID: ENST00000425906
  CDS Start-End: 212-705
atcccgggattccccagctctcgcgctgggcccgccgcgttcgcaccaagcacgccaggcggccctggcctacctccctcccgcctcccggcagctggcacgagggaacctggccgtcaggtttcccctgggatcctgggacggtatcaggcggggaatctgtgcggccgcggcgaggtgatttatttggcataaaagtattctttcaaggatggcagaagctgttttgattgatctttttggtttgaaattgaactctcaaaaaaactgccatcagacattactgaagactttgaatgctgtccaataccaccatgctgccaaggccaagtttctctgtataatgtgttgcagtaacatcagctatgaaagggatggagaacaagataattgtgaaatagaaacaagcaatggattatcagctctcttggaagaatttgagattgttagctgtcccagcatggctgccactttgtataccattaaacagaaaattgatgaaaaaaatctgagcagcattaaggtaattgtacccaggcacaggaagacattaatgaaagcttttattgatcaactcttcactgatgtttacaattttgaatttgaagatttgcaagtgacttttaggggagggctttttaaacagtccattgaaataaacgtaatcacagctcaagaactaagaggaattcagaatgaaataga

SEQ ID NO: 147271 - DNA, 551 bp, Homo sapiens
  Payload ID: 9128
  Gene Symbol: LACRT
  Gene Name: lacritin
  Uniprot ID: Q9GZZ8
  ENST ID: ENST00000257867
  CDS Start-End: 55-471
attccccagaccttctgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaatccatagtggagaaaagtatcttactaacagaacaagcccttgcaaaagcaggaaaaggaatgcacggaggcgtgccaggtggaaaacaattcatcgaaaatggaagtgaatttgcacaaaaattactgaagaaattcagtctattaaaaccatgggcatgagaagctgaaaagaatgggatcattggacttaaagccttaaatacccttgtagcccagagctattaaaacgaaagcatcca

SEQ ID NO: 147272 - DNA, 504 bp, Homo sapiens
  Payload ID: 9128
  Gene Symbol: LACRT
  Gene Name: lacritin
  ENST ID: ENST00000547511
  CDS Start-End: 40-423
tgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaacaagcccttgcaaaagcaggaaaaggaatgcacggaggcgtgccaggtggaaaacaattcatcgaaaatggaagtgaatttgcacaaaaattactgaagaaattcagtctattaaaaccatgggcatgagaagctgaaaagaatgggatcattggacttaaagccttaaatacccttgtagcccagagctattaaaacgaaagcatccaa

SEQ ID NO: 147273 - DNA, 391 bp, Homo sapiens
  Payload ID: 9128
  Gene Symbol: LACRT
  Gene Name: lacritin
  ENST ID: ENST00000546721
  CDS Start-End: 1-258
cctgcccaggaagctgggacctctaagcctaatgaagagatctcaggtccagcagaaccagcttcacccccagagacaaccacaacagcccaggagacttcggcggcagcagttcaggggacagccaaggtcacctcaagcaggcaggaactaaaccccctgaaacaagcccttgcaaaagcaggaaaaggaatgcacggaggcgtgccaggtggaaaacaattcatcgaaagtgagtgcatcccaagatggaagtgaatttgcacaaaaattactgaagaaattcagtctattaaaaccatgggcatgagaagctgaaaagaatgggatcattggacttaaagccttaaatacccttgtagcccagagctattaaaacgaaagcatccaa

SEQ ID NO: 147274 - DNA, 728 bp, Homo sapiens
  Payload ID: 9129
  Gene Symbol: LALBA
  Gene Name: lactalbumin, alpha-
  Uniprot ID: P00709
  ENST ID: ENST00000301046
  CDS Start-End: 27-455
atttcaggttcttgggggtagccaaaatgaggttctttgtccctctgttcctggtgggcatcctgttccctgccatcctggccaagcaattcacaaaatgtgagctgtcccagctgctgaaagacatagatggttatggaggcatcgctttgcctgaattgatctgtaccatgtttcacaccagtggttatgacacacaagccatagttgaaaacaatgaaagcacggaatatggactcttccagatcagtaataagctttggtgcaagagcagccaggtccctcagtcaaggaacatctgtgacatctcctgtgacaagttcctggatgatgacattactgatgacataatgtgtgccaagaagatcctggatattaaaggaattgactactggttggcccataaagccctctgcactgagaagctggaacagtggctttgtgagaagttgtgagtgtctgctgtccttggcacccctgcccactccacactcctggaatacctcttccctaatgccacctcagtttgtttctttctgttcccccaaagcttatctgtctctgagccttgggccctgtagtgacatcaccgaattcttgaagactattttccagggatgcctgagtggtgcactgagctctagacccttactcagtgccttcgatggcactttcactacagcacagatttcacctctgtcttgaataaaggtcccactttgaagtca

SEQ ID NO: 147275 - DNA, 1243 bp, Homo sapiens
  Payload ID: 9129
  Gene Symbol: LALBA
  Gene Name: lactalbumin, alpha-
  ENST ID: ENST00000549817
  CDS Start-End: 47-418
tgaaactgagtgatgcttccatttcaggttcttgggggtagccaaaatgaggttctttgtccctctgttcctggtgggcatcctgttccctgccatcctggccaagcaattcacaaaatgtgagctgtcccagctgctgaaagacatagatggttatggaggcatcgctttgcctgaattgatctgtaccatgtttcacaccagtggttatgacacacaagccatagttgaaaacaatgaaagcacggaatatggactcttccagatcagtaataagctttggtgcaagagcagccaggtccctcagtcaaggaacatctgtgacatctcctgtgacaagttcctggatgatgacattactgatgacataatgtgtgccaagaagatcctggatattaaaggaattgactactggtgaatccttattctattttctatttccccatcctccttctccttaccccattagcccagcacccctttcctcttaccctatctcttggtcatttaatctagaatacagtgtctgaaacaaagcttacctagagactcaggtttctgttattaagcctctctcgctccgctccttggtagcaattttcctaataaggggttgcctaatggagggctcagacccaggcctcctttcacttagacttggacatctaattccacttgtttagttctatgccctaaagcaagctgttggtaacattgcatctcttttttaaccctacaattttcttggatattttttatggactgtattccacttgatggcttgtgtcgcttgacatcaggccaggaatgtctttctgtaattctcgtccacgctcttccacttcagccctcctgggaatgaatgtaaagattcagtcagctaactcaccttgtcccccttctccattatcaggttggcccataaagccctctgcactgagaagctggaacagtggctttgtgagaagttgtgagtgtctgctgtccttggcacccctgcccactccacactcctggaatacctcttccctaatgccacctcagtttgtttctttctgttcccccaaagcttatctgtctctgagccttgggccctgtagtgacatcaccgaattcttgaagactattttccagggatgcctgagtggtgcactgagctctagacccttactcagtgccttcgatggcactttcactacagcacagatttcacctctgtcttgaataaaggtcccactttgaa

SEQ ID NO: 147276 - DNA, 1972 bp, Homo sapiens
  Payload ID: 9130
  Gene Symbol: LACTB
  Gene Name: lactamase, beta
  Uniprot ID: P83111
  ENST ID: ENST00000261893
  CDS Start-End: 73-1716
cttccctccgccccgcgccgcggctggcagggtgtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgcaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgcaatggcgtggggtgttgtggaaaggaaacaaacgtatggttcgtgtagaaagcaacggcattatgcttcacatactggaggggcagtgggtgccagtagtgtcctgctggtccttcctgaagaactggatacagagactataaataacaaggttcccccaagaggaatcattgtttctatcatatgtaacatgcaatctgttggcctcaatagcaccgctttgaagattgcccttgaatttgataaagacagatcagactgataaccttaacaccataggtgcaaaatgagttgttctgaggtttttttgaaacattaaagttccaaaacatgacatttttaagaataaatttgaaatagagtataactgaatgcagagaattatgtacctctaattgcttaattttgtaatggtcttttattgtagaattggttctttatactcagggaagtaattatattgtttttactttttgaaaaaagtgttaactcttgaaataaaatattctgataaaata

SEQ ID NO: 147277 - DNA, 2978 bp, Homo sapiens
  Payload ID: 9130
  Gene Symbol: LACTB
  Gene Name: lactamase, beta
  Uniprot ID: P83111
  ENST ID: ENST00000413507
  CDS Start-End: 40-1161
gtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgaggggcgcggccccggcgcagtcccccgcggcccccgaccctgaggcgtcgcctctggccgagccgccacaggagcagtccctcgccccgtggtctccgcagaccccggcgccgccctgctccaggtgcttcgccagagccatcgagagcagccgcgacctgctgcacaggatcaaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaaggtaaatgaataccttctgctgtgtctagctatatcgcatcttaacactattttattaattaaaagtcaaattttctttgtttccattccaaaatcaacctgccacattttgggagcttttctacatgtctgttttctcatctgtaaagtgaaggaagtaaaacatgtttataaagtacactaagaccctttgatgaaagatagcaataatattaataattcaaacatgaataactaaaccaaaattgcacccaccatgagcatctgtaatttgctctttaaccattccttttttaggttttaactaatactttgtttacgtgttattagtttttaattgttttcatactgttttgaaataattttatacttatagaaaagttgcaagagtagtacaaaggattcacatatcctctttactcagattcccttaatgttagtttaccgcatttgcattacctttctgtctacatatgtgtttgtttctgaaccatttggaaataagttgtagacgtgatacccctttacctataaatatttacatgtgtattttctaaaaacaaggacattcagggccgggtgcagtggctcacgcctgtaatcccaacactttggaaggccgaggtgggtggatcacctgaggtcaggagttcaagaccagcctggccaatgtggtgaaatcaaccctctctctactaaaaatgcaaaaattagccaggtgtggtggcgggtgcctataatcccagccacgcgggaggctgaggcaggagaatcgcttgaacccaggaggtggagttgcagtaagccaagatcgtgcccctgcacttcaggctgggcgaaagagtgagactccatgtcaaaaaaggaaaaaaaaaaaaaaaaaaaggacatttgggaaattaacatagatacaatgcttttattaaatctacagaccttactcaaattttgccagttgttccaataatgtcctttatagcaaaagagcagaaaaacttttttttctggtctaggatctaatccatgatctcacattgcatttacttgtcatatctatcagaagtcacttgacatcagtttgtcccattattgctgatggtattttaatcactttttgaggtggtgcctgtcaggttattgtaaagttactatttttactttataattaacaagtatatttggaggagataatttgagatgatgtaaaaatcctctttctcatcaaactttctactagttttagcatctatcagtgattcatgactgaatcagttattacagtgatggttgtcaaatggtgattttctaattccatcatccattctgtatttatcagttggcattctattataagaaggtgcgggccggggcggtggctcacgcctgtaatcccatcactttgggaggctgaggtgggcggatcacatgagaccaagtttgagaccagcctggccaacatggcgaaaccccatctctactgaaaatacaaaaaatcagccgggcatggtggcatacacttgtaatctcggctgctcgggagtctgaggcaggagaatctcttgaacccaggaggcagaggttgcagtgagccaagatcatgccactgcactccagcctgggcgacaaagtgagactccatctcagaaaaaaaagtgctttcccttctctcttatttatttattcataccagtatgcactcatggattcttattttagtcaatgagttataatctgtcactgtcattatttaatatgttgcttttaaaatagtatatgaaataataaaactgtaacagtaaatggttattagattgcttaccta

SEQ ID NO: 147278 - DNA, 552 bp, Homo sapiens
  Payload ID: 9130
  Gene Symbol: LACTB
  Gene Name: lactamase, beta
  ENST ID: ENST00000557972
  CDS Start-End: 174-552
ctgggctttttcagcaggcccgtaactgtcggttctttccccttcggtcttaggatgaggtgggcgcaccgggcatagtggttggagtttctgtagatggaaaagaagtctggtcagaaggtttaggttatgctgatgttgagaaccgtgtaccatgtaaaccagagacagttatgcgaattgctagcatcagcaaaagtctcaccatggttgctcttgccaaattgtgggaagcagggaaactggatcttgatattccagtacaacattatgttcccgaattcccagaaaaagaatatgaaggtgaaaaggtttctgtcacaacaagattactgatttcccatttaagtggaattcgtcattatgaaaaggacataaaaaaggtgaaagaagagaaagcttataaagccttgaagatgatgaaagagaatgttgcatttgagcaagaaaaagaaggcaaaagtaatgaaaagaatgattttactaaatttaaaacagagcaggagaatgaagccaaatgccggaattcaaaacctggcaagaaaaagaatg

SEQ ID NO: 147279 - DNA, 1508 bp, Homo sapiens
  Payload ID: 9131
  Gene Symbol: LACTB2
  Gene Name: lactamase, beta 2
  Uniprot ID: Q53H82
  ENST ID: ENST00000276590
  CDS Start-End: 38-904
cagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttcagagaatggtatgttttcttaactataggttattttatagagaatataaaagtataaaacattaaaaataaccctagatatactttaaaataatgttatatttatgctaaaatatgtaaattacactatacaaccatatgataggttatttctctaaccttgtcttctaacgttttaccaaaaattcataatctaatagtttatcagttttcaatagattaaataaaatgattactttaaaaataataaaatttatctaatttaaagttgatattatttttggccgttagttatctattactagtgatcagttatactgttttctatagctactttatttaacagcacagatttctatgcacctttactctttcctcaacccttgtctctatctgtacataattgctttgtcttgatgtttctatcaactatatcatgactatctattggttccataactctgtatcatgtgtattttcttattctggtataccacaaatgattcatgcaaatgaatttttggtgattgaaaaatattaaattcccaatttaaagtattatatgata

SEQ ID NO: 147280 - DNA, 1034 bp, Homo sapiens
  Payload ID: 9131
  Gene Symbol: LACTB2
  Gene Name: lactamase, beta 2
  Uniprot ID: Q53H82
  ENST ID: ENST00000522447
  CDS Start-End: 55-921
ttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcattaaaaaactcccacggaatcctcagagagaagaaattataggaaatggagagcaacaatatgtttatctgaaagatggagatgtgattaagactgagggagccactctaagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggacatggcccagtaattcataatgctgaagctaaaattcaacaatacatttctcacagaaatattcgagagcagcaaattcttacattatttcgtgagaactttgagaaatcatttacagtaatggagcttgtaaaaattatttacaagaatactcctgagaatttacatgaaatggctaaacataatctcttacttcatttgaaaaaactagaaaaagaaggaaaaatatttagcaacacagatcctgacaagaaatggaaagctcatctttagtttcagattaaagaaagctttgttttattttgctttcagagaatgaatctcactgtgttgcccaggctagagtgcggtggtgcgatttcagctcacagcaacctctgcctcct

SEQ ID NO: 147281 - DNA, 1641 bp, Homo sapiens
  Payload ID: 9132
  Gene Symbol: LACTBL1
  Gene Name: lactamase, beta-like 1
  ENST ID: ENST00000426928
  CDS Start-End: 1-1641
atgactggctgcttcctgtggcagtatcacctccccaagctgaagaccggttccctgggaccagaggagacctctgcccctgtgaggatgtgtccccggcaccctgagcccgtgcccctggctcacccactccccgtgttgaaggaggccctggaaaaggtggaccagatcctgcgccaggcaatgtctgccccaggcgtggctgccatgtctgcagttgtcatccacaatgatactgtgctctggacagggaactttgggaagaagaatggctcagacccggcttctggggcccccaatgagtacaccatgtacaggatctccagcatctccaagatctttcctgtcctcatgctgtaccgtctgtgggaggagggcatcgtggcctccctagatgaccctctggagcggtatgccagcaccttcaccattaacaacccgctgggcctggcatcagccgaacagcagggcctgatggacgggctggagcaggtgggccccgccccaaggccttcacctgtcacccttcgaaggatggccagccagctctcagggctgcccagaaggctgcgctccacttcactgctgtggaagggcagcacccaggaggccctgaacctgctcaaggacgatgtgctggtagtggacccgggaaccagatgccattacagcacgctggccttctcgctcctggcccacgtcctggcagctcacaccgcccagggcgactaccagcgctgggtctcggagaacgtgctggagccgctggggatggcagacacgggctttgacctcacgcccgacgtgcgcgcgcgcctggccgcgggcttctacggcagcgggcggccggcgccactctatgacctgggctggtaccggccgtcgggccagatgtactctaccgccgccgacctggccaagctggccgtggcgctcctgggcggcgggccccggcggctcctgcggcccgacgcggccaagacgctgctggcgccgctgctggcctgcccgggcgcctacttcgccaacgagacgggcacgccgtgggagttccacgcgcagcggggctaccgcgtggtgcgcaaggacggcgatctggacggctacgccgccaccttctcgctggtgcccccgctgcgtctgggcctggtgctgctgctggcagggccacggccgcccgggcccgacctggtggcgcgggcctacgatgagctcctgcccgccctggagcgcgccctccgggaggccgagcccggcccggctccgccgcccaccgcgcaccccttcgccggctacttcaccttcgccaacctgaccttctacgaggtgcgcgccgggccggcgggcgagctgcgcctgcgccagttcgggccgcgcgtggaggcgctggtgcctccagcgttccgcaccctggcgctgcgccacctgcacggccgcgtcttccagctgcacgtggcccacgagttcccctgcgcactgccactcggcgacgcgtggctctcgctcgaggcccagcacgggcagctggtcaacttctaccccttggatcaccacgggctgtcacccggcttcgacgtgcccggcctcaacacgtacagagtgctgcggctgcggggcaagccggtgttcaagacccagtga

SEQ ID NO: 147282 - DNA, 1500 bp, Homo sapiens
  Payload ID: 9132
  Gene Symbol: LACTBL1
  Gene Name: lactamase, beta-like 1
  Uniprot ID: A8MY62
  ENST ID: ENST00000618559
  CDS Start-End: 1-1500
atgtgtccccggcaccctgagcccgtgcccctggctcacccactccccgtgttgaaggaggccctggaaaaggtggaccagatcctgcgccaggcaatgtctgccccaggcgtggctgccatgtctgcagttgtcatccacaatgatactgtgctctggacagggaactttgggaagaagaatggctcagacccggcttctggggcccccaatgagtacaccatgtacaggatctccagcatctccaagatctttcctgtcctcatgctgtaccgtctgtgggaggagggcatcgtggcctccctagatgaccctctggagcggtatgccagcaccttcaccattaacaacccgctgggcctggcatcagccgaacagcagggcctgatccttcgaaggatggccagccagctctcagggctgcccagaaggctgcgctccacttcactgctgtggaagggcagcacccaggaggccctgaacctgctcaaggacgatgtgctggtagtggacccgggaaccagatgccattacagcacgctggccttctcgctcctggcccacgtcctggcagctcacaccgcccagggcgactaccagcgctgggtctcggagaacgtgctggagccgctggggatggcagacacgggctttgacctcacgcccgacgtgcgcgcgcgcctggccgcgggcttctacggcagcgggcggccggcgccactctatgacctgggctggtaccggccgtcgggccagatgtactctaccgccgccgacctggccaagctggccgtggcgctcctgggcggcgggccccggcggctcctgcggcccgacgcggccaagacgctgctggcgccgctgctggcctgcccgggcgcctacttcgccaacgagacgggcacgccgtgggagttccacgcgcagcggggctaccgcgtggtgcgcaaggacggcgatctggacggctacgccgccaccttctcgctggtgcccccgctgcgtctgggcctggtgctgctgctggcagggccacggccgcccgggcccgacctggtggcgcgggcctacgatgagctcctgcccgccctggagcgcgccctccgggaggccgagcccggcccggctccgccgcccaccgcgcaccccttcgccggctacttcaccttcgccaacctgaccttctacgaggtgcgcgccgggccggcgggcgagctgcgcctgcgccagttcgggccgcgcgtggaggcgctggtgcctccagcgttccgcaccctggcgctgcgccacctgcacggccgcgtcttccagctgcacgtggcccacgagttcccctgcgcactgccactcggcgacgcgtggctctcgctcgaggcccagcacgggcagctggtcaacttctaccccttggatcaccacgggctgtcacccggcttcgacgtgcccggcctcaacacgtacagagtgctgcggctgcggggcaagccggtgttcaagacc

SEQ ID NO: 147283 - DNA, 6279 bp, Homo sapiens
  Payload ID: 9133
  Gene Symbol: LCT
  Gene Name: lactase
  Uniprot ID: P09848
  ENST ID: ENST00000264162
  CDS Start-End: 12-5795
gttcctagaaaatggagctgtcttggcatgtagtctttattgccctgctaagtttttcatgctgggggtcagactgggagtctgatagaaatttcatttccaccgctggtcctctaaccaatgacttgctgcacaacctgagtggtctcctgggagaccagagttctaactttgtagcaggggacaaagacatgtatgtttgtcaccagccactgcccactttcctgccagaatacttcagcagtctccatgccagtcagatcacccattataaggtatttctgtcatgggcacagctcctcccagcaggaagcacccagaatccagacgagaaaacagtgcagtgctaccggcgactcctcaaggccctcaagactgcacggcttcagcccatggtcatcctgcaccaccagaccctccctgccagcaccctccggagaaccgaagcctttgctgacctcttcgccgactatgccacattcgccttccactccttcggggacctagttgggatctggttcaccttcagtgacttggaggaagtgatcaaggagcttccccaccaggaatcaagagcgtcacaactccagaccctcagtgatgcccacagaaaagcctatgagatttaccacgaaagctatgcttttcagggcggaaaactctctgttgtcctgcgagctgaagatatcccggagctcctgctagaaccacccatatctgcgcttgcccaggacacggtcgatttcctctctcttgatttgtcttatgaatgccaaaatgaggcaagtctgcggcagaagctgagtaaattgcagaccattgagccaaaagtgaaagttttcatcttcaacctaaaactcccagactgcccctccaccatgaagaacccagccagtctgctcttcagcctttttgaagccataaataaagaccaagtgctcaccattgggtttgatattaatgagtttctgagttgttcatcaagttccaagaaaagcatgtcttgttctctgactggcagcctggcccttcagcctgaccagcagcaggaccacgagaccacggactcctctcctgcctctgcctatcagagaatctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggcgttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgctgaatgagccctttgtcattgcttaccagggctatggctacggaacagcagctccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccagatgctggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatgtttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttctccta

SEQ ID NO: 147284 - DNA, 3508 bp, Homo sapiens
  Payload ID: 9133
  Gene Symbol: LCT
  Gene Name: lactase
  ENST ID: ENST00000452974
  CDS Start-End: 1-3012
aaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaaggctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgctgaatgagccctttgtcattgcttaccagggctatggctacggaacagcagctccagttcatgggaggctggtttgcacatcctattttcaagaatggagattacaatgaggtgatgaagacgcggatccgtgacaggagcttggctgcaggcctcaacaagtctcggctgccagaatttacagagagtgagaagaggaggatcaacggcacctatgacttttttgggttcaatcactacaccactgtcctcgcctacaacctcaactatgccactgccatctcttcttttgatgcagacaggtaagtccaccaacagggagcccggagccatctctggaaaaggcagaaaggtgcccttggctgtgctctctgaggcctgcccagcctcaaaacagggcctccaacgccgaatgtgccggggtttgcaagatgctcgccaccccacagatcccaaggaaatctccagcaagcaagagggagagaaggccggggtctccagggcacctcccattagggcacatgtgcttggctttttgtttttttatttcatttttaaaatttatttattttgcgttctttttcacaggctgcttaactctaaaaa

SEQ ID NO: 147285 - DNA, 3147 bp, Homo sapiens
  Payload ID: 9134
  Gene Symbol: LCTL
  Gene Name: lactase-like
  Uniprot ID: Q6UWM7
  ENST ID: ENST00000341509
  CDS Start-End: 133-1836
gatcaagcgccttcctttcccttcctctccccacttggcctttgccctaagccaagacctggccatcagcctggctgcaggggcctgcagagccagctgcactttttcaggtatgggggagggccaggcaccatgaagccagtgtgggtcgccacccttctgtggatgctactgctggtgcccaggctgggggccgcccggaaggggtccccagaagaggcctccttctactatggaaccttccctcttggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaattaaaaaaaaaaacacttgtaatctcacccctcctaaagttaatgttaagattttgctgtatataatgaatgtatattatgaattatttacaaaaatggcatcatagtatacaaactgttgtgacttgattgtttatcactctaaaatctgtccagaaatattactttaatgttcaaatgattgccatctcagcactgtcccatacctgatagataaaatcaatctggctgggcacagtggctcacacctgtaatcccagcactttgggaggctgaggctggtgaatcacttgaggccagaagtttgagaccagcctggccaacatggttaaaccctgtctctactaaaaatatagaaactagctgggcatggtggcgggcacctgtaatcccatttacttgggaggctgaggcaggagaatcgcttgaacctgggaggtgaaggttgcagtgagctgagatcacaccactgcactccagcctgtgcaacagagaaagactccgtttcaaaagagaaaagaaaagaaatctatagataacaatccttccaggttgtaaatattattagccaaccacagaaaagcatgaagtgggtaccaagtaaatgagcacgtacactcttctgacactttagtctgaatttagtctgacaactctgactaaattcaacttactttagtcaatgaaatacctcaaagaaatattacatgtttattttttatttatcttctaggtaactcaatatcgtcttttttataataaagattcattttactcttaactatgttaaaatgctaaaattaattaatttccatttatttggggataaaacatggcttaagaacaatctcatgcatttttctcattatctgattttacttaatactgtttctgaaaccaaaaaagaataagacagtagaaaatgtctctactaaaaatacaaaaaattagccaagcgtggtggcaggcgcctgtagtcccagctacttgggaggctgaggcaggagaatggcattgaatctgggaggcggagcttgcagtgagccgagatagcgccactgcactccagcctgggtgacagagcgggactgtgtctcaaaaaaaaaaaaaaaaaaaaaaaaagaaaatgtcatt

SEQ ID NO: 147286 - DNA, 2552 bp, Homo sapiens
  Payload ID: 9134
  Gene Symbol: LCTL
  Gene Name: lactase-like
  Uniprot ID: Q6UWM7
  ENST ID: ENST00000537670
  CDS Start-End: 346-1530
gctgtggctcctctctcaggggacagcgtaggccctgggggtcagttggagagggctctgactaccagcgactgctctgggggtgtctgcgatcaaggacgatcctgggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggcaatggcagaaaaaggctatgagacgggccaccatgcgccgggcctgaagctccgcggcaccggcctgtacaaggcagcacaccacatcattaaggcccacgccaaagcctggcattcttataacaccacgtggcgcagcaagcagcaaggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagctataaaagatggtgctaatataaaggggtatacttcctggtctctgttggataagtttgaatgggagaaaggatactcagatagatatggattctactatgttgaatttaacgacagaaataagcctcgctatccaaaggcttcagttcaatattacaagaagattatcattgccaatgggtttcccaatccaagagaggtggaaagttggtacctcaaagctttggaaacttgctctatcaacaatcagatgcttgctgcagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattagaaaataaaaataagcagaaattaaaaaaaaaaacacttgtaatctcacccctcctaaagttaatgttaagattttgctgtatataatgaatgtatattatgaattatttacaaaaatggcatcatagtatacaaactgttgtgacttgattgtttatcactctaaaatctgtccagaaatattactttaatgttcaaatgattgccatctcagcactgtcccatacctgatagataaaatcaatctggctgggcacagtggctcacacctgtaatcccagcactttgggaggctgaggctggtgaatcacttgaggccagaagtttgagaccagcctggccaacatggttaaaccctgtctctactaaaaatatagaaactagctgggcatggtggcgggcacctgtaatcccatttacttgggaggctgaggcaggagaatcgcttgaacctgggaggtgaaggttgcagtgagctgagatcacaccactgcactccagcctgtgcaacagagaaagactccgtttcaaaagagaaaagaaaagaaatctatagataacaatccttccaggttgtaaatattattagccaaccacagaaaagcatgaagtgggtaccaagtaaatgagcacgtacactcttctgacactttagtctgaatttagtctgacaactctgactaaattcaacttactttagtcaatgaaatacctcaaagaaatattacatgtttattttttatttatcttctaggtaactcaatatcgtcttttttataataaagattcattttactcttaactatgttaaaatgctaaaattaattaatttccatttatttggggataaaacatggcttaagaac

SEQ ID NO: 147287 - DNA, 1451 bp, Homo sapiens
  Payload ID: 9134
  Gene Symbol: LCTL
  Gene Name: lactase-like
  ENST ID: ENST00000565875
  CDS Start-End: 525-635
agagccttcggctgtgctgtggctcctctctcaggggacagcgtaggccctgggggtcagttggagagggctctgactaccagcgactgctctgggggtgtctgcgatcaaggacgatcctgggcttctcctggggcgtgggcagttctgcctaccagacggagggcgcctgggaccaggacgggaaagggcctagcatctgggacgtcttcacacacagtgggaaggggaaagtgcttgggaatgagacggcagatgtagcctgtgacggctactacaaggtccaggaggacatcattctgctgagggaactgcacgtcaaccactaccgattctccctgtcttggccccggctcctgcccacaggcatccgagccgagcaggtgaacaagaagggaatcgaattctacagtgatcttatcgatgcccttctgagcagcaacatcactcccatcgtgaccttgcaccactgggatctgccacagctgctccaggtcaaatacggtgggtggcagaatgtgagcatggccaactacttcagagactacgccaacctgtgctttgaggcctttggggaccgtgtgaagcactggatcacgttcagtgatcctcgggtctggtgggaatttcattgaactgtgactggggggaacctgtggacattagtaaccccaaggacctagaggctgccgagagatacctacagttctgtctgggctggtttgccaaccccatttatgccggtgactacccccaagtcatgaaggactacattggaagaaagagtgcagagcaaggcctggagatgtcgaggttaccggtgttctcactccaggagaagagctacattaaaggcacatccgatttcttgggattaggtcattttactactcggtacatcacggaaaggaactacccctcccgccaggggcccagctaccagaacgatcgtgacttgatagagctggttgacccaaactggccagatctggggtctaaatggctatattctgtgccatggggatttaggaggctccttaactttgctcagactcaatacggtgatcctcccatatatgtgatggaaaatggagcatctcaaaaattccactgtactcaattatgtgatgagtggagaattcaataccttaaaggatacataaatgaaatgctaaaagagcccttgctaagtcacatgcaaatggttacggagatcgtggtacccactgtctgctccctctgtgtcctcatcactgctgttctactaatgctcctcctgaggaggcagagctgagacaggattatcaattttggagcttcataagagaatcttcaggatcttcctcccttttctgctttgagggtttccatacattgctgttttcaggttctacaataattacctttttttctctttctctttttggcttgtgctgggatttaagaattag

SEQ ID NO: 147288 - DNA, 1887 bp, Homo sapiens
  Payload ID: 9135
  Gene Symbol: LDHA
  Gene Name: lactate dehydrogenase A
  Uniprot ID: P00338
  ENST ID: ENST00000227157
  CDS Start-End: 76-801
tccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 147289 - DNA, 1922 bp, Homo sapiens
  Payload ID: 9135
  Gene Symbol: LDHA
  Gene Name: lactate dehydrogenase A
  Uniprot ID: P00338
  ENST ID: ENST00000379412
  CDS Start-End: 358-1356
taaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtga

SEQ ID NO: 147290 - DNA, 1766 bp, Homo sapiens
  Payload ID: 9135
  Gene Symbol: LDHA
  Gene Name: lactate dehydrogenase A
  Uniprot ID: P00338
  ENST ID: ENST00000396222
  CDS Start-End: 100-924
agtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 147291 - DNA, 2416 bp, Homo sapiens
  Payload ID: 9135
  Gene Symbol: LDHA
  Gene Name: lactate dehydrogenase A
  Uniprot ID: P00338
  ENST ID: ENST00000422447
  CDS Start-End: 274-1272
agtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgcacatttttctgaaaatacaactgtgaccctta

SEQ ID NO: 147292 - DNA, 1310 bp, Homo sapiens
  Payload ID: 9135
  Gene Symbol: LDHA
  Gene Name: lactate dehydrogenase A
  Uniprot ID: P00338
  ENST ID: ENST00000430553
  CDS Start-End: 100-924
agtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctg

SEQ ID NO: 147293 - DNA, 576 bp, Homo sapiens
  Payload ID: 9135
  Gene Symbol: LDHA
  Gene Name: lactate dehydrogenase A
  ENST ID: ENST00000543445
  CDS Start-End: 107-576
agagtgctgcagccgctgccgccgattccggatctcattgccacgcgcccccgacgaccgcccgacgtgcattcccggtacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccg

SEQ ID NO: 147294 - DNA, 554 bp, Homo sapiens
  Payload ID: 9135
  Gene Symbol: LDHA
  Gene Name: lactate dehydrogenase A
  ENST ID: ENST00000543695
  CDS Start-End: 99-239
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcaccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttaggga

SEQ ID NO: 147295 - DNA, 516 bp, Homo sapiens
  Payload ID: 9135
  Gene Symbol: LDHA
  Gene Name: lactate dehydrogenase A
  ENST ID: ENST00000536528
  CDS Start-End: 99-236
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagag

SEQ ID NO: 147296 - DNA, 732 bp, Homo sapiens
  Payload ID: 9135
  Gene Symbol: LDHA
  Gene Name: lactate dehydrogenase A
  ENST ID: ENST00000478970
  CDS Start-End: 300-732
gacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgact

SEQ ID NO: 147297 - DNA, 664 bp, Homo sapiens
  Payload ID: 9135
  Gene Symbol: LDHA
  Gene Name: lactate dehydrogenase A
  ENST ID: ENST00000486690
  CDS Start-End: 26-163
gattccttttggttccaagtccaatatggcaactctaaaggatcagctgatttataatcttctaaaggaagaacagaccccccagaataagattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattg

SEQ ID NO: 147298 - DNA, 1340 bp, Homo sapiens
  Payload ID: 9135
  Gene Symbol: LDHA
  Gene Name: lactate dehydrogenase A
  ENST ID: ENST00000545215
  CDS Start-End: 99-236
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaaca

SEQ ID NO: 147299 - DNA, 556 bp, Homo sapiens
  Payload ID: 9135
  Gene Symbol: LDHA
  Gene Name: lactate dehydrogenase A
  ENST ID: ENST00000539814
  CDS Start-End: 99-383
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagctctccctaattgtagttacataaagttacaacttgactaaaactacaaggaagatgttgacatgctcttcctccatttaagaagccataatgataaaactctaagaacaagaaagactataatgtaactgcaaactccaagctggtcattatcacggctggggcacgtcagcaagagggagaaagccgtcttaatttggtccagcgtaacgtg

SEQ ID NO: 147300 - DNA, 582 bp, Homo sapiens
  Payload ID: 9135
  Gene Symbol: LDHA
  Gene Name: lactate dehydrogenase A
  ENST ID: ENST00000541097
  CDS Start-End: 99-368
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttcct

SEQ ID NO: 147301 - DNA, 570 bp, Homo sapiens
  Payload ID: 9135
  Gene Symbol: LDHA
  Gene Name: lactate dehydrogenase A
  ENST ID: ENST00000545467
  CDS Start-End: 100-228
agtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaagtagagacggggtttcaccatgttagccaggatggtctcgatctcctgacctcgtgatccgcctaccttggcctcccaaagtgctgggattacaagcgtgagccaccgtgcctggcctggccaggctgtcttgaactcctgacctcaagtgatgtgcccgcctcggcctcccaaagtgttgggattacagatgacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcatta

SEQ ID NO: 147302 - DNA, 465 bp, Homo sapiens
  Payload ID: 9135
  Gene Symbol: LDHA
  Gene Name: lactate dehydrogenase A
  ENST ID: ENST00000535451
  CDS Start-End: 249-465
gtgctgcagccgctgccgccgattccggatctcattgccacgcgcccccgacgaccgcccgacgtgcattcccggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttcctta

SEQ ID NO: 147303 - DNA, 2305 bp, Homo sapiens
  Payload ID: 9135
  Gene Symbol: LDHA
  Gene Name: lactate dehydrogenase A
  Uniprot ID: P00338
  ENST ID: ENST00000540430
  CDS Start-End: 283-1368
ttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcaggg

SEQ ID NO: 147304 - DNA, 1288 bp, Homo sapiens
  Payload ID: 9135
  Gene Symbol: LDHA
  Gene Name: lactate dehydrogenase A
  Uniprot ID: P00338
  ENST ID: ENST00000542179
  CDS Start-End: 290-1288
gaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaa

SEQ ID NO: 147305 - DNA, 682 bp, Homo sapiens
  Payload ID: 9135
  Gene Symbol: LDHA
  Gene Name: lactate dehydrogenase A
  ENST ID: ENST00000495052
  CDS Start-End: 339-682
gctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaa

SEQ ID NO: 147306 - DNA, 141 bp, Homo sapiens
  Payload ID: 9135
  Gene Symbol: LDHA
  Gene Name: lactate dehydrogenase A
  ENST ID: ENST00000625635
  CDS Start-End: 1-141
atggcaactctaaaggatcagctgatttataatcttctaaaggaagaacagaccccccagaataagattacagttgttggggttggtgctgttggcatggcctgtgccatcaccgtcttaatttggtccagcgtaacgtga

SEQ ID NO: 147307 - DNA, 2526 bp, Homo sapiens
  Payload ID: 9136
  Gene Symbol: LDHAL6A
  Gene Name: lactate dehydrogenase A-like 6A
  Uniprot ID: Q6ZMR3
  ENST ID: ENST00000280706
  CDS Start-End: 798-1796
acacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtgagtggccatgagctgggctgcaagagtcctggggagcagccagagagcgggcgccgcgggagcgaattgtttttgcccaaggatggttctgtgtctccgccaggcggcatgtgacctgctcgggcgcgggtggcccttcacccctgtgagtgtggccagaagtacctctcacctggacctgcggaccccgggcgcagtcctggagctgagaactggaggttgggggaacagcagggtaaaggggagagaaaagggggtcagctgcgggacggagtgccgtcccagctgtagtttcatgtttggtggagcaacccctgttcctttcctctctctctctcttaattcctcttaactgtactcacgcttccttctccttcccctggtccgcttcatggatgctgagctgcctggccagaacctacccagcttctttgctggtcagatttgtcggtcttttgtgtgtctgcagcacctccttccacacgggcccaggagttctctatacgcgctctcaccgcaggtcttggaattccaagccatttccaattccaggtcttggaaatggctgtgcaatttgtcttcactgttaggtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacaatcatggctcactgcaaccttgacctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattacaggggtgagccactgtgcctggccttagctttgatttagtatccagatgatagatgacacttttttttttttttttttaaagtgacggcatcaaagatgtttttggtacttctcagtacttgccttgtatgtatacgtaattgccatctggtccacaagaatgtgtttactgtgttacacaaatcctgattcttttcatcaggtgcatagtaattcttctctatggcttaatacctatgttcatttacatgctatctctacaatgtaaaaataaaagtgtatatatatacacacacacacagagagtaatctaaatgttcctaacactagataaaacattgatttg

SEQ ID NO: 147308 - DNA, 1716 bp, Homo sapiens
  Payload ID: 9136
  Gene Symbol: LDHAL6A
  Gene Name: lactate dehydrogenase A-like 6A
  Uniprot ID: Q6ZMR3
  ENST ID: ENST00000396213
  CDS Start-End: 265-1263
ggcagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaaagtgatttccagtggctatgagatggtcaaaatgaaaggttatacttcttggggcattagcctatctgtagctgatttaacagaaagtattttgaagaatcttaggagagtgcatccagtttctaccctaagtaagggcctctatggaataaatgaagacatattccttagtgtcccatgtatcctgggagagaatggtatcacagacctcataaaagtaaaactgactcttgaagaggaggcctgcttgcaaaagagtgcagaaacactttgggaaattcagaaggagctcaagctttaaagttgcttaaagctaattctgtagattgaagatgaaatagtagttatggaattgtatatgtcaaacttttgaataaatttgaatttctaaaagttggaaaaatagaggaaagagtgacctatttagtatagccttccagcttttttttttttcttttttgggagggtctcattctgtcacccaggctggagtgcagtggcacaatcatggctcactgcaaccttgacctcccgagctcaggtgagcctcccacttcagcctccagagtaggtgggaccacatgcgtgtgcctccatgcctgcctaatttttgtatctttttgtagagatggggttttgccatgtcatccaagctggttttgaactcccaaagtgctgagattacaggggtgagccactgtgcctggccttagctttgatttagtatccagatgatagatgacacttttttttt

SEQ ID NO: 147309 - DNA, 1042 bp, Homo sapiens
  Payload ID: 9136
  Gene Symbol: LDHAL6A
  Gene Name: lactate dehydrogenase A-like 6A
  ENST ID: ENST00000615355
  CDS Start-End: 265-966
ggcagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttcttcacctcttgagtttccaagatggcaactatcaagagtgaacttattaagaatttcgcggaagaggaggccattcatcacaataagatctccattgtaggaactggatcggttggtgtggcttgtgctatcagcatcttattaaaaggtttgagtgatgaacttgtccttgtggatgttgatgaaggcaaactgaagggtgagacaatggatcttcaacatggcagcccttttatgaaaatgccaaatattgtctccagcaaagattacctggtcactgcaaactccaatctagtgattatcacagcaggtgcacgccagaaaaaaggagaaacacgccttgatttagtccagcgaaatgtatccatctttaaattaatgattcccaatattacccagtacagtcctcactgcaaactgcttattgttactaatccagtggatatcttaacttatgtagcctggaagttgagtggatttcccaaaaaccgtgttattggaagtggttgtaatctggactctgctcgttttcgttactttattgggcaaaggcttggcatccactctgaaagctgtcatgggctgatccttggagagcatggcgactcaagtgttcctgtgtggagtggtgtgaacattgctggcgtccctctgaaggatctgaacccagatataggaactgataaagatcctgagcagtgggaaaatgtccacaaaaagtgatttccagtggctatgagatggtcaaaatgaaaggttatacttcttggggcattagcctatctgtagctgatttaac

SEQ ID NO: 147310 - DNA, 1693 bp, Homo sapiens
  Payload ID: 9137
  Gene Symbol: LDHAL6B
  Gene Name: lactate dehydrogenase A-like 6B
  Uniprot ID: Q9BYZ2
  ENST ID: ENST00000307144
  CDS Start-End: 119-1264
ggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaa

SEQ ID NO: 147311 - DNA, 1303 bp, Homo sapiens
  Payload ID: 9138
  Gene Symbol: LDHB
  Gene Name: lactate dehydrogenase B
  Uniprot ID: P07195
  ENST ID: ENST00000350669
  CDS Start-End: 99-1103
cttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtg

SEQ ID NO: 147312 - DNA, 744 bp, Homo sapiens
  Payload ID: 9138
  Gene Symbol: LDHB
  Gene Name: lactate dehydrogenase B
  ENST ID: ENST00000396075
  CDS Start-End: 47-744
tggacgatctttacctcgaatatttgaatatattgccacgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataa

SEQ ID NO: 147313 - DNA, 1538 bp, Homo sapiens
  Payload ID: 9138
  Gene Symbol: LDHB
  Gene Name: lactate dehydrogenase B
  Uniprot ID: P07195
  ENST ID: ENST00000396076
  CDS Start-End: 334-1338
tccgcacgactgttacagaggtctccagagccttctctctcctggtaggtttcggctcaggaccctgaatcctggcccacaggcaagcctgatgggacgtgcggggtagtacttgtatggggagacgcgggaaggaggaagaagcacatctgtcctccgcggcctttagctctgagcatccggccgcgggccctgactttgccgctcagtttggggcgcagggggggccgtgccctggcggaggagcagaaggcagagggtagcagctgcggctcagcggagagacttgttgcatttgcagctaaaaccaggccctacttgtccttgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtg

SEQ ID NO: 147314 - DNA, 732 bp, Homo sapiens
  Payload ID: 9138
  Gene Symbol: LDHB
  Gene Name: lactate dehydrogenase B
  ENST ID: ENST00000450584
  CDS Start-End: 323-732
gcagagccggcgccggaggagacgcacgcagctgactttgtcttctccgcacgactgttacagaggtctccagagccttctctctcctggagccatgcgccagttctttcctgcagggcctcttttctggatgcttaggggcttcgtttactttaccagccttgggtgctccgagtaaggaagtcctagacttgtccccacagaccttactcggggagatctctagcttctgcatgccctcgtgatctgctgttctttgctgccggtgccctgaggaaaagatggtttgtgcgcaccgcgagcagtacaagctgcatgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggt

SEQ ID NO: 147315 - DNA, 487 bp, Homo sapiens
  Payload ID: 9138
  Gene Symbol: LDHB
  Gene Name: lactate dehydrogenase B
  ENST ID: ENST00000539782
  CDS Start-End: 182-487
agaagccagagcagacagcaatttcgggacattgcagagctgtagtagatctgtactggtctgcagacagacaataatttgcactaagaccaggaagacgttctgtgaggaagacataggtggaaatacggaaagcagaaaagacaacttcggggtggccgggagataacagaagtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgactgccaattctaagattgtagtggtaactgcaggagtccgtcagcaa

SEQ ID NO: 147316 - DNA, 1256 bp, Homo sapiens
  Payload ID: 9139
  Gene Symbol: LDHC
  Gene Name: lactate dehydrogenase C
  Uniprot ID: P07864
  ENST ID: ENST00000280704
  CDS Start-End: 142-1140
ggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctg

SEQ ID NO: 147317 - DNA, 1092 bp, Homo sapiens
  Payload ID: 9139
  Gene Symbol: LDHC
  Gene Name: lactate dehydrogenase C
  ENST ID: ENST00000396215
  CDS Start-End: 96-251
gcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctg

SEQ ID NO: 147318 - DNA, 2041 bp, Homo sapiens
  Payload ID: 9139
  Gene Symbol: LDHC
  Gene Name: lactate dehydrogenase C
  Uniprot ID: P07864
  ENST ID: ENST00000541669
  CDS Start-End: 112-1110
gtgcgtgtctcgagtcgcacggagggcaaccgtcgacgggcttagcgcctcaactgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctgtgacataactctagtctctcaagattagaacgagcaaatggtaaagagattttcctctttaagaatcatttatagctctattctaatgatacccaatctgtacaggtgtaagttatacttctgaggtatgtcacatatgttagagtgccttcagatgtagtagaatatgtataatcactataatacagagctttgattcttttcacaaaccaagccctttttctagtattacaattttatcttgtactttcatccgttagagtaccagcatattcacttcattacattagcgtcatatgtttatgtataatcattataaatgtggccgggcactgcagcctgggtgaaagagtgaggctctgtctcaaaaaaaatcattataaatgcttatttttaagaccatatatatcaaaaagaaataaaaagctgagtgctgtggctcatggctgtaatcccagtgctttgggagggtgaggcaagaggatcacatgagtccaggagtttgagaccagccttggcaacatagcaacaccccatctctacaaaaataaagaaattagatgtggtggcctgcatctgtagtccagctacttgggagactgagaccagtagataacttgagcccaggagttcaaggctatgattgtgtcactgcactccagcctgggccacagaggaagactcagactcaaaagaagaagaagaacacagaagaaaagcagaaacaagaagaagatacagatgtaactttacgatgtaaaaaatctaaataagattgtattcaactctgcaagtattatactagtcatataaac

SEQ ID NO: 147319 - DNA, 813 bp, Homo sapiens
  Payload ID: 9139
  Gene Symbol: LDHC
  Gene Name: lactate dehydrogenase C
  ENST ID: ENST00000545848
  CDS Start-End: 59-214
ctgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctg

SEQ ID NO: 147320 - DNA, 875 bp, Homo sapiens
  Payload ID: 9139
  Gene Symbol: LDHC
  Gene Name: lactate dehydrogenase C
  ENST ID: ENST00000544105
  CDS Start-End: 1-726
atgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaa

SEQ ID NO: 147321 - DNA, 957 bp, Homo sapiens
  Payload ID: 9139
  Gene Symbol: LDHC
  Gene Name: lactate dehydrogenase C
  ENST ID: ENST00000536880
  CDS Start-End: 1-957
atgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaa

SEQ ID NO: 147322 - DNA, 583 bp, Homo sapiens
  Payload ID: 9139
  Gene Symbol: LDHC
  Gene Name: lactate dehydrogenase C
  ENST ID: ENST00000537486
  CDS Start-End: 1-504
atgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaa

SEQ ID NO: 147323 - DNA, 881 bp, Homo sapiens
  Payload ID: 9139
  Gene Symbol: LDHC
  Gene Name: lactate dehydrogenase C
  ENST ID: ENST00000539369
  CDS Start-End: 59-196
ctgtcgttggtgtatttttctggtgtcacttctgtgccttccttcaaaggttctccaaatgtcaactgtcaaggagcagctaattgagaagctaattgaggatgatgaaaactcccagtgtaaaattactattgttggaactggtgccgtaggcatggcttgtgctattagtatcttactgaagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagtgcctatgaaattatcaagctgaaggggtatacctcttgggctattggactgtctgtgatggatttggtaggatccattttgaaaaatcttaggagagtgcacccagtttccaccatggttaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaaattaaagccttctaatgttccactgtttggagaacagaagatagcaggctgtgtattttaaattttgaaagtattttcatttgatctttaaaaaataaaaacaaattggagacctg

SEQ ID NO: 147324 - DNA, 701 bp, Homo sapiens
  Payload ID: 9139
  Gene Symbol: LDHC
  Gene Name: lactate dehydrogenase C
  ENST ID: ENST00000546146
  CDS Start-End: 1-552
atgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgtgcccttatggagtggggtgaatgttgctggtgttgctctgaagactctggaccctaaattaggaacggattcagataaggaacactggaaaaatatccataaacaagttattcaaagggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaa

SEQ ID NO: 147325 - DNA, 757 bp, Homo sapiens
  Payload ID: 9139
  Gene Symbol: LDHC
  Gene Name: lactate dehydrogenase C
  ENST ID: ENST00000535809
  CDS Start-End: 1-678
atgtcaactgtcaaggagcagctaattgagaagctaattgaggatgatgaaaactcccagtgtaaaattactattgttggaactggtgccgtaggcatggcttgtgctattagtatcttactgaaggatttggctgatgaacttgcccttgttgatgttgcattggacaaactgaagggagaaatgatggatcttcagcatggcagtcttttctttagtacttcaaagattacttctggaaaagattacagtgtatctgcaaactccagaatagttattgtcacagcaggtgcaaggcagcaggagggagaaactcgccttgccctggtccaacgtaatgtggctataatgaaatcaatcattcctgccatagtccattatagtcctgattgtaaaattcttgttgtttcaaatccagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtgggattatatggaataaaagaagaactctttctcagtatcccttgtgtcttggggcggaatggtgtctcagatgttgtgaaaattaacttgaattctgaggaggaggcccttttcaagaagagtgcagaaacactttggaatattcaaaaggatctaatattttaa

SEQ ID NO: 147326 - DNA, 2067 bp, Homo sapiens
  Payload ID: 9140
  Gene Symbol: LDHD
  Gene Name: lactate dehydrogenase D
  Uniprot ID: Q86WU2
  ENST ID: ENST00000300051
  CDS Start-End: 48-1571
ggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagcta

SEQ ID NO: 147327 - DNA, 1966 bp, Homo sapiens
  Payload ID: 9140
  Gene Symbol: LDHD
  Gene Name: lactate dehydrogenase D
  Uniprot ID: Q86WU2
  ENST ID: ENST00000450168
  CDS Start-End: 52-1506
gactggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaa

SEQ ID NO: 147328 - DNA, 701 bp, Homo sapiens
  Payload ID: 9140
  Gene Symbol: LDHD
  Gene Name: lactate dehydrogenase D
  ENST ID: ENST00000569876
  CDS Start-End: 36-143
acccagtgctcacaccctctggccagtgcctggctatggcccgactgctcaggtctgcaacctgggagctgttcccctggaggggctactgctcccagaaggcaaaggtaccgggagagaagagaagtcctctggagggatgagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccg

SEQ ID NO: 147329 - DNA, 5208 bp, Homo sapiens
  Payload ID: 9141
  Gene Symbol: LACE1
  Gene Name: lactation elevated 1
  Uniprot ID: Q8WV93
  ENST ID: ENST00000368977
  CDS Start-End: 187-1632
cggaaggacgggagggcacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaatctgatataaactaaaagggataatattttagaatatgggcttatatgtggtttttttttttggttatgaattacagtaaatctcccaggccttcagatttctacataatggaagaatatgtttttaaccctgagatcaagtttagtaggcaggacttgatctcaagtggtcacaaagttttctaaaaaaaaatagaaaattatgatgggatcaaataaggagcaagtgtcaaattccagccaacaggcagatctgcaggcagagctacaaactctgcagccaggaatggggaccagtgagagagtgtgggcgggggggtgggtgtcagagtcgtaggcactccaacagcagaggagactcccgctcacatgaggccagccgtaccccagtggacagcaggctccttctcactgttgtagacacttgctctccttgcagcatgctgcccccgcccttgccgccaactctgccgtgagatggacctaataggaaataggaaagaaagcctgacaagcctgcttcacaggaaatctgatttgtccttcactgagctcatcttttgcttctttgagtaaaacctggctttactaactattgtcacaaagtggatcttcggctgtggatgagtgtgaaaaacagaaaaaatataaaatccacaaaatcttgtgaaaattaagcatttgggggaaggtaaggcataggtgagtcagtccaatgaatacaatggtcaacataagtaagctctttgaacctatttattttctatttattattatttttattttttatatcttggccactctagccatctcctggcaggggtagtgtggcacagcatggccctatttaatttcttagtcaataatccatcacatagtctcttttagatattaacctaattaaggcaagcaggtagatggatgagtacccaagccgagagaagagtttaaatcaagccttctgtaaataaaatgtggtttaaagatatttttattgaagtgaaacacagtaatttcaaagaggttacgtaatagggagaaaggatgggaaataaccactttgtgctggattgaatgctatatatttacattagctcagttaaaaaaaatagtcttagaaagtgaatattataacccctgtttaaaaataagaaaactgagtcttgggaaagttaagtagcttgacctgagattcacagtttacaactacaaaactcatatactatattttataacacactgtctcttactcttactatttaaaaaaaagagattgttttaaaaattgattcatttaactcagtgaatgaagttgaagataaattcacaacagaaccattgatttgaactcagtgaatataaaatgtttaactttattctttagatcttagctttttacttttcacattcctttggtaattattctgtatcttaatttttaaaaaaatcatgtgaatggacagacagatagatggacagtatgaccgatagacagacctgtccctgagtgtgagtgtatgtagaagagtccccctgtcaagttatgttataaaagttcatctgaggtcagatattgggaataaagtttcatttttccatcgaaacaatcacgtaatgttagttggggtgctggtcaaacgcatagaagcctatgtaattctcagtgtagcttccctataatgtcattttggtacgaaagaacttaaaccctgagaaaaaaactgtagctcagtctccacctaagtaactggagcatgtgcccacttctgtgcccccaatccgcaatctccttccccagttccaggggcctgctgggattggctgcagtggaagaggctctttgagctgggagaagggtttatgcagaaagtggggctagaaggctttggctggatctctggaggggagggagttccatggtggctggaaatctccaaagctggtttcataaaatagcatgcaagaaaaaaacccaagtcttcaagaatagccatcactaggaaacagtatggtagctctactaaaagaaaagtaatgccaacatgaaaaacaacccctagattggagagcaacatttcactttatatgtctttcttctgagccctgcccctattacattctcagcattccagtctttctccatagaagtctctcagcaaatgctctttttttgaaatgctttaaatgtatactttgagacggaggtttgagctgagtactgctgtggaaagctcctgctcaattcaaaacacagaccggggggatgtctttagagtcaggagaaaacatcatgtgccaagggtgctctccaaactgatgactagttcccagacttaacagaggtcaagcggagaaaaaggaaaactttctttagagaagaaaaagaaaaatcttatcacttctcatatttctttaggcagtgtatgagcttatttgctgatatcactaatcctgagatgaaaaacaggatggacttaagtaatttttaacctatttctgaggccaaaaagactgtagtattattttaatcaaatttatgcattttcagtgggacttcaaattttaataataaggcaatacttttatcttcttaaagtatatttcctgtacttataagtgtgcaaatgacataattttaaaattagttggaatattgaaaaaaattaaaatttcacttgtaaaataagtggatgtgcttatatccatttatttatttaagaaacacatgatgttttctgtgtcctgggcatggttctatgtgctttataaataaactcttttgatccatataacagtcttatgagataggtgccattataatcattttatagacagggaagctgagacacagaaaacagctaaaacagattaatgaattgctaagatataaccgaagtcaataaaattagcaaagtgctaacgtattaaattttccatttcattgcctctgtcctgaaaacagtattgctggtccaagtaacttgaacctacacttgacggctgctttatctgagattaaaaacatgcagaaggattgggcgcctgggtccctgacatttgggttcttgatcagttacgggaatctgtcttgcagcaagtctgtaagttacctttattagatttactaatctcaaaagaa

SEQ ID NO: 147330 - DNA, 742 bp, Homo sapiens
  Payload ID: 9141
  Gene Symbol: LACE1
  Gene Name: lactation elevated 1
  ENST ID: ENST00000437715
  CDS Start-End: 263-742
ctccctggcttccttcattcagttatatgttcatgaatgaatgaatgaatgtatattctgagtaaccaagagtgccagttttactgctctattcatgtattcgcactaaactgcacgattttcaaagagatgaggtcttgctatgttgccaaggctggagtgcagtggccattcacaggtatgatcatggtgctctgcagcctccaacttttggtttcaagggatcctcctgcctcagcctcccaagtagctgggactacagatgtgtgccactccacccagcctcaactttaaaaaattagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatat

SEQ ID NO: 147331 - DNA, 1741 bp, Homo sapiens
  Payload ID: 9141
  Gene Symbol: LACE1
  Gene Name: lactation elevated 1
  ENST ID: ENST00000421954
  CDS Start-End: 1-1049
ggaagcccttttggaaaggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaatctgatataaactaaaagggataatattttagaatatgggcttatatgtggtttttttttttggttatgaattacagtaaatctcccaggccttcagatttctacataatggaagaatatgtttttaaccctgagatcaagtttagtaggcaggacttgatctcaagtggtcacaaagttttctaaaaaaaaatagaaaattatgatgggatcaaataaggagcaagtgtcaaattccagccaacaggcagatct

SEQ ID NO: 147332 - DNA, 779 bp, Homo sapiens
  Payload ID: 9141
  Gene Symbol: LACE1
  Gene Name: lactation elevated 1
  ENST ID: ENST00000431865
  CDS Start-End: 1-242
gaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaaga

SEQ ID NO: 147333 - DNA, 2979 bp, Homo sapiens
  Payload ID: 9142
  Gene Symbol: LPO
  Gene Name: lactoperoxidase
  Uniprot ID: P22079
  ENST ID: ENST00000262290
  CDS Start-End: 317-2455
cagggcatgcagtttttgccttccggaactagatcaggatcatgcatttaagctagaaaatggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagcgcagactaccagaacctctgccatctccgatactgtgagtcaggccaaggtccaagtcaacaaggccttcctggactcccgaaccaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcca

SEQ ID NO: 147334 - DNA, 1942 bp, Homo sapiens
  Payload ID: 9142
  Gene Symbol: LPO
  Gene Name: lactoperoxidase
  ENST ID: ENST00000389576
  CDS Start-End: 1-354
ttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggtaaggagaccgaggctcagaagtgttaagtaacttgtccaaggtcacacagctaaaaagagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcca

SEQ ID NO: 147335 - DNA, 2729 bp, Homo sapiens
  Payload ID: 9142
  Gene Symbol: LPO
  Gene Name: lactoperoxidase
  Uniprot ID: P22079
  ENST ID: ENST00000421678
  CDS Start-End: 317-2206
cagggcatgcagtttttgccttccggaactagatcaggatcatgcatttaagctagaaaatggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggcc

SEQ ID NO: 147336 - DNA, 2350 bp, Homo sapiens
  Payload ID: 9142
  Gene Symbol: LPO
  Gene Name: lactoperoxidase
  ENST ID: ENST00000543544
  CDS Start-End: 241-2202
gctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctca

SEQ ID NO: 147337 - DNA, 1970 bp, Homo sapiens
  Payload ID: 9142
  Gene Symbol: LPO
  Gene Name: lactoperoxidase
  ENST ID: ENST00000580890
  CDS Start-End: 1-288
ggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaa

SEQ ID NO: 147338 - DNA, 2680 bp, Homo sapiens
  Payload ID: 9142
  Gene Symbol: LPO
  Gene Name: lactoperoxidase
  Uniprot ID: P22079
  ENST ID: ENST00000582328
  CDS Start-End: 559-2448
actacatttggccacaattctgattagtatcataattagtattagatggcacatcaccaccgtaacacccactggcagttggctgaggcctaaaagtggccaagtctatgaggtccttcccgagctcggcagcaggctgataatgaagaaagttgcttgatgtgattctttgcaggtggactctgtcaagaaaagcccaaaatattcgttaccagacacgcaaccaggagatgaacacaaagcaaggatgggggaaacaaaacagaggaggctggagtgcaatggcatgatcttggctcactgcaacccctgcctcccaggttcaagtgattctcccacctcagcctcccaggtagctgggattacagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcagtgatgagggtccttctccatctcccagccctcctggcttccctcatcttgcttcaggctgcagcatctaccacaagagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaagacgcgcaacggcttccctctcccgctggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatgttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcgtgcagattatcacctttagggactacctacccattttgctaggtgaccacatgcagaagtggatacccccatatcaaggctacagtgaatctgtggatcccagaatttccaatgtcttcaccttcgccttccgctttggccacttggaggtcccctctagtatgttccgcctggatgagaattatcagccatgggggccagaaccagaactccccctccacaccctcttcttcaacacttggaggatggtcaaagatggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctgggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccgctggtggaaaggggtcgggtggggcctctcctggcctgcctcttgggcaagcagttccagcagatccgtgatggagacaggttctggtgggaaaaccctggggtcttcacgaacgagcagaaggactctctacagaaaatgtccttctcacgccttgtctgtgacaacacccgcatcaccaaggtcccacgggacccattctgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatacccctggatgaacagcttgctcaggccccagggtggctgcctcggccctcccagctcttacactcagctccagtggcttctcctttctgtcaagacttagccccgct

SEQ ID NO: 147339 - DNA, 585 bp, Homo sapiens
  Payload ID: 9142
  Gene Symbol: LPO
  Gene Name: lactoperoxidase
  ENST ID: ENST00000581008
  CDS Start-End: 217-585
cgtgaaaagacaaggcactgggcagggtgtctggtgctcctttggctttctctgctttctgtggttcaaaccctcccacttggtctctagagaggctcacagtgtgatcctgcatctcgtttcagtgatgagggtccttctccatctcccagccctcctggcttccctcatcttgcttcaggctgcagcatctaccacaagaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacagatcccagcctggacttgacttcactgtctctggaggtgggctgtggtgctcctgctcccgtggtgagatgcgacccgtgcagcccttaccgcaccattacgggagactgcaataacaggaggaagcctgcgctgggcgccgccaacagggctctggcgcgctggctgcccgcggagtacgaggacgggctctccctgcccttcggctggacgccggggaag

SEQ ID NO: 147340 - DNA, 2979 bp, Homo sapiens
  Payload ID: 9143
  Gene Symbol: LTF
  Gene Name: lactotransferrin
  Uniprot ID: P02788
  ENST ID: ENST00000231751
  CDS Start-End: 297-2429
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttataaagtgtcactcatcttttctagaattttatactgaaatcacatgcctgacaaaatacctgtacagttggaccttcccttccaagtttttcaggtccagcccctcctctttcttgcagtcttgggtatgatgcccaagggtctggaatttaaggccaggccaagcaccggttttcctaaggggatcttgttggttattcacatagctgtctcagtgcacgtgcatgtatgtgcctgggagtgtgtgcgtgtccccaaggcagggcaggaagagcaagcataggaattataactgaaatgtaggttcagttgctcatcacttgcagagtctaattaacaagagctaggtttggtataaag

SEQ ID NO: 147341 - DNA, 584 bp, Homo sapiens
  Payload ID: 9143
  Gene Symbol: LTF
  Gene Name: lactotransferrin
  ENST ID: ENST00000431944
  CDS Start-End: 39-584
agagccttcgtttgccaagtcgcctccagaccgcagacatgaaacttgtcttcctcgtcctgctgttcctcggggccctcggttttttgtggatgccttttatcaggcaaccaggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttc

SEQ ID NO: 147342 - DNA, 2656 bp, Homo sapiens
  Payload ID: 9143
  Gene Symbol: LTF
  Gene Name: lactotransferrin
  ENST ID: ENST00000443496
  CDS Start-End: 569-2656
acgtggccttcacagctggcctgagtgagcacagcgggcactgaggggaacaaagcgtgggggccctccagcagcccttatcatcacctgccagccacctgcctcaggctgggcaggctgcaccctgggctttctgctattggcttcccagatccctggaactccagctggggccctgggctgtggtctgacttgatccagaatttaatgagtagaaggaatggaagaaggctcattcccccagccctggacacagacagcagacacagaggcctccagcacagtgaagcctgtggagcagtcccctccagaatgcaaccttgtaggagggcagcaccatgggccagcaactcagggtgatcagcaaataaatgatcaatactaagacaccaaggccctaagaagtcactggatggggtcccgggtggatttctagctctactgtccactggctgtgagaccatgaacagggtgcattgcccaagtccactcagctggaaacaggctctttgagatctgacccaactcctggcacgttggagatgtcccatagaccagtgttgaatgaatgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcagg

SEQ ID NO: 147343 - DNA, 2130 bp, Homo sapiens
  Payload ID: 9143
  Gene Symbol: LTF
  Gene Name: lactotransferrin
  ENST ID: ENST00000417439
  CDS Start-End: 2-2128
catgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaa

SEQ ID NO: 147344 - DNA, 2494 bp, Homo sapiens
  Payload ID: 9143
  Gene Symbol: LTF
  Gene Name: lactotransferrin
  Uniprot ID: P02788
  ENST ID: ENST00000426532
  CDS Start-End: 318-2318
gtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttg

SEQ ID NO: 147345 - DNA, 2336 bp, Homo sapiens
  Payload ID: 9144
  Gene Symbol: LAD1
  Gene Name: ladinin 1
  ENST ID: ENST00000367313
  CDS Start-End: 60-1655
gtccgacggtccacccagtgcttgcggcctcgcggccgggccggcctgggctgcaatcaatgcggctttgtctgggacgcccacatcccagaggccattcccgggtcggcaaatcggagcgcggccggggcgcgcggggccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagaga

SEQ ID NO: 147346 - DNA, 2906 bp, Homo sapiens
  Payload ID: 9144
  Gene Symbol: LAD1
  Gene Name: ladinin 1
  Uniprot ID: O00515
  ENST ID: ENST00000391967
  CDS Start-End: 303-1856
cccgggcagccgaccagccccacgccggccccgggcgtccgtcgttcggtcccgcgatccgtccgacggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggcggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaa

SEQ ID NO: 147347 - DNA, 582 bp, Homo sapiens
  Payload ID: 9144
  Gene Symbol: LAD1
  Gene Name: ladinin 1
  ENST ID: ENST00000503578
  CDS Start-End: 1-579
gaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgagtccccgctgagactgagcagacgcctccaggatctgtcggcagctgctgttctgagggagagcagagaccatgtctgacat

SEQ ID NO: 147348 - DNA, 589 bp, Homo sapiens
  Payload ID: 9144
  Gene Symbol: LAD1
  Gene Name: ladinin 1
  ENST ID: ENST00000633953
  CDS Start-End: 56-589
agcatggctgtcagcaggaaggactggtccgcgctgtccagatctgtggagctccatggctcaactctttccacgaagctctttccatctgaaaggtgagggaggctccaagagcccctgggaagtgaaaggaaggcgatattggagttttttccatggccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctg

SEQ ID NO: 147349 - DNA, 565 bp, Homo sapiens
  Payload ID: 9144
  Gene Symbol: LAD1
  Gene Name: ladinin 1
  ENST ID: ENST00000632743
  CDS Start-End: 1-565
agtcaccctgatgaggcacctggaacagaggaccgctcccgctccgctccctgggtgaacaagcctcagcgggcaggcaggaaagggctccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaag

SEQ ID NO: 147350 - DNA, 550 bp, Homo sapiens
  Payload ID: 9144
  Gene Symbol: LAD1
  Gene Name: ladinin 1
  ENST ID: ENST00000631576
  CDS Start-End: 1-550
attcatctcagcgaggcctactgggacggtgggcccggccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcct

SEQ ID NO: 147351 - DNA, 2900 bp, Homo sapiens
  Payload ID: 9145
  Gene Symbol: LBX1
  Gene Name: ladybird homeobox 1
  Uniprot ID: P52954
  ENST ID: ENST00000370193
  CDS Start-End: 980-1825
gtccctcccgggctggggttcccaccactctttcgggctccacatcccgggtcggagagaccgagaccttcgggccggtgcggtcattgcagctaggccggcgggaggcgggtgcgccaggagcgcggctcgcagtttggggtgggggcggtggcttttcagtcgcccgaggttcgggtgcaataaaggagcagctaatgtaatttacaaacagctcgggccgaacgcagcgcagcgcccggactgacaggcgcattaggcaggctaattccagccggctcctcctacccccggcccgctaattaatgagcttcccaacttacagccgcctgcattggacagacagagagtgaaagagagggcgagggagagggagagaaggagagagaaggggggagcagagaagagagaagagagagggagggagggagagcgagaacaggaggagagaacagaggcaaagaagagaggaaaaagggagaaaggagagagaaagagaaagaagtgccgctgcagataattgattacaccgcgatcaaggctaacttgttagcaatagtcaattgccccgtctctccgcctccctcgcagtccgggatcggcgccctcgcctcggctcttccaactgcggccgccaggacccggggccaggagccactgccgagccacctgacacctttaaatagcaccggggttggcgaaactggagccccgcgcagcgcgccccggctccggccccggattgctggaagccccagcagcagcggcgcccgcgtcagcgccctcttcccggggccccgcgctgttctcccctcctcagccgccgcgctaatcggccccgcgcccggcccgcgccctgcccagtgcggcctcctttccacccgccgctgcctgcccgcgccgtccggcgcccgagctgcccgcgggctgggtccccgcggcccgagccgccccggccgggaccccgaacaaggccgagatgacttccaaggaggacggcaaggcggcgccgggggaggagcggcggcgcagcccgctggaccacctgcctccgcctgccaactccaacaagccactgacgccgttcagcatcgaggacatcctcaacaagccgtctgtgcggagaagttactcgctgtgcggggcggcgcacctgctggccgccgcggacaagcacgcgcagggcggcttgcccctggcgggccgcgcgctgctctcgcagacctcgccgctgtgcgcgctggaggagctcgccagcaagacgtttaaggggctggaggtcagcgttctgcaggcagccgaaggccgcgacggtatgaccatctttgggcagcggcagacccctaagaagcggcgaaagtcgcgcacggccttcaccaaccaccagatctatgaattggaaaagcgctttctataccagaagtacctgtcccccgccgatcgcgaccaaatcgcgcagcagctgggcctcaccaacgcgcaagtcatcacctggttccagaatcggcgcgctaagctcaagcgggacctggaggagatgaaggccgacgtagagtccgccaagaaactgggccccagcgggcagatggacatcgtggcgctggccgaactcgagcagaactcggaggccacagccggcggtggcggcggctgcggcagggccaagtcgaggcccggctctccggtcctccccccaggcgccccgaaggccccgggcgctggcgccctgcagctctcgcctgcctctccgctcacggaccagccggccagcagccaggactgctcggaggacgaggaagacgaagagatcgacgtggacgattgagcggcgccccgggtcttccgccgccctgggctcctagcgctcgaaagcccaacgcctcccggaccggaccgccgaggggagctgggacctcctctgccaactcccgcctcctcccctgtccccggccccggactcggctcctggcagccgcctcttccctctcgaagcaataaacccaggctggccggccgggccggccgccaccagcggcctccgccgccccggaagccctcgccgtgcaattctgtatggcttctatataaatatttaaacctatatagcgggttcttcccaccgcagcctgatttttcctttcttttattattattttttaaatctcggagatttcgatgttttcaaagctctcgggctgccgggtttgctgagggcgagacagaaaccagggcggggaacactaaccctgcggtctaggggagtggcagctccggctgttttgatttttctctgcatgtggcgaatgcaccggcccgctccttcctcgcctccctcggccttattgcagttgacttctatttcctcgggccttttttcctcatgtgggaggggaagaggtgggcagtcaggtcctgacttgcaagtttcaaaatcgatctttcctccccaccctctgagagaaaagtctgttttcgatgccatttctgcctcctaatgcccactaatgctgtttttaagattcctccctccctcccgcatttcctcggactgactgttggagtccggctcttagggacaatgcagggggaaatccaaccaaccaactatcgaaaacagaacccaaagccctataattattttgtactctttttagaatttttttgcatgtgacagagacagagaggaggccgacccaagccctcacctcacctcctccacagctctgggtctctcttgccacttcgaacaccccactcctacccgacttggccagaggagggtggctggatgtgagtgggctgcgagtgccccttccctgctcctcccttcccctctcctccctagactgtacccaaggcctctttctccaataaataaagtctttgccattttactagaa

SEQ ID NO: 147352 - DNA, 1186 bp, Homo sapiens
  Payload ID: 9146
  Gene Symbol: LBX2
  Gene Name: ladybird homeobox 2
  Uniprot ID: Q6XYB7
  ENST ID: ENST00000377566
  CDS Start-End: 180-776
gatccaccgcggcccggggtggagaggtgggggcgcaggaggaggggcacacgggactcgggcccagagccgggggcgggtccgaggctgggggcccggattgggagccgagcactggggcccaggcgtttgcggagcctagcgcaacggacagccggaccgccccagcccggccgaccatgaactcgggacgcgagccccgaacaccccggacactcttaagcatcgcagacatcctagccccgcgcatggtcccccgagcaccctctgcgccgcagcttccagagtcgggtccgggtccaacgtcgccgctgtgcgcgctggaggagctgactagtaaaactttccgcggacttgacgcgcgcgctctgcagccctctgaagggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgca

SEQ ID NO: 147353 - DNA, 1452 bp, Homo sapiens
  Payload ID: 9146
  Gene Symbol: LBX2
  Gene Name: ladybird homeobox 2
  Uniprot ID: Q6XYB7
  ENST ID: ENST00000460508
  CDS Start-End: 458-1042
gcactgcgtctcccaaggtggctgaagctggccagctgcgggctccgcgccgctcgtcccgggtctatgggtccattccccacgcccacccggaccccggggtcactcgggtctccgtctgtgccagggagggagaatcacgcccagggtcctctctggcttcgcgcgactgagaacgcgcccggacgcggcgcggcgctcctgagtcaaaggagaggtggcggcaggaccaccccagggcgccgtctgcacccccggacgcactcggccgtgctgcgcttccgggacaaggcgtcggttctcgcctgagggccaaaccttgcccctgcccaccttcctcacccccgccatttccaggactcacatccaaaggcgacagcaccaggatttgctcccgcctttggcacagaggaggacgggtccctctctcagcctggccagtctttcccagggcttgatgggaaaaaggacttccctagaagtgagtcttggggagttggggggagaaaagtgtcgaggagggcgtcggagtttcccaccgctggctgcttcccggcccgcacgcccgggagggtggcggtgggcgcgcagagatctttgcaaaacagcgtccagggcggaaaacaactcacaggcctgccgcccccaaaggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagaggaggtcccgctatgttgtccaggctactttcccaatatttgagaataaagtcgagactctgccgca

SEQ ID NO: 147354 - DNA, 886 bp, Homo sapiens
  Payload ID: 9146
  Gene Symbol: LBX2
  Gene Name: ladybird homeobox 2
  ENST ID: ENST00000341396
  CDS Start-End: 126-299
ccttcctcacccccgccatttccaggactcacatccaaaggcgacagcaccaggatttgctcccgcctttggcacagaggaggacgggtccctctctcagcctggccagtctttcccagggcttgatgggaaaaaggacttccctagaaggcgggcaggtccggacgcgctgggccctggtcccttcggccgcaaacggcgcaagtcacgcactgcgttcaccgcgcaacaggtgctggagctggagcggcgcttcgtcttccagaagtacctggcgccgtccgagcgagacgggctagctacgcgactcggcctggccaacgcgcaggtggtcacttggttccagaaccggcgagccaagctcaagcgcgatgtggaggagatgcgcgccgacgtcgcctcgctacgcgcgttgtccccggaagtcctgtgcagcttagcactgcccgaaggcgctccagatcccggcctctgcctcggccctgccggccctgactcccggccccacctgtcagacgaggagatacaggtggacgattgaagacaaagccgccgccaatcctgggctctggggccctggactcctcacctcgcgctctgcctctggccagagttccagggtggaggaaggaggtccacttgggcctcttccggcccacagtccagacgctcacctttcccggtttttttgtaagtttgttttgttgtctgagacagggcctcgctctgtcgcccaggctggagtgccgtggagcgatcaccgctcactgcagtcgcgacctcctgggctcaagcgatcctcctgcctcaacctcccgactagctggcattacaggcgtgcagcaccaccccaggctaatttaaaaaacttttttttttagagagg

SEQ ID NO: 147355 - DNA, 4581 bp, Homo sapiens
  Payload ID: 9147
  Gene Symbol: LVRN
  Gene Name: laeverin
  Uniprot ID: Q6Q4G3
  ENST ID: ENST00000357872
  CDS Start-End: 125-3097
aggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcagggccctgttagcgtcccagctggaaccaacatttgccaggtatgttttcccttgttttgatgagccagctctgaaggcaacttttaatattacaatgattcatcatccaagttatgtggccctttccaacatgccaaagctaggtcagtctgaaaaagaagatgtgaatggaagcaaatggactgttacaaccttttccactacgccccacatgccaacttacttagtcgcatttgttatatgtgactatgaccacgtcaacagaacagaaaggggcaaggagatacgcatctgggcccggaaagatgcaattgcaaatggaagtgcagactttgctttgaacatcacaggtcccatcttctcttttctggaggatttgtttaatatcagttactctcttccaaaaacagatataattgccttgcctagttttgacaaccatgcaatggaaaactggggactaatgatatttgatgaatcaggattgttgttggaaccaaaagatcaactgacagaaaaaaagactctgatctcctatgttgtctcccacgagattggacaccagtggtttggaaacttggttaccatgaattggtggaacaatatctggctcaacgagggttttgcatcttattttgagtttgaagtaattaactactttaatcctaaactcccaagaaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaaggcgattcctgttattcacagactgcagttgattgatgatgccttttccttgtctaaaaacaattatattgagattgaaacagcacttgagttaaccaagtaccttgctgaagaagatgaaattatagtatggcatacagtcttggtaaacttggtaaccagggatcttgtttctgaggtgaacatctatgatatatactcattattaaagaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaaatcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgccta

SEQ ID NO: 147356 - DNA, 4544 bp, Homo sapiens
  Payload ID: 9147
  Gene Symbol: LVRN
  Gene Name: laeverin
  ENST ID: ENST00000395528
  CDS Start-End: 125-3061
aggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcagggccctgttagcgtcccagctggaaccaacatttgccaggtatgttttcccttgttttgatgagccagctctgaaggcaacttttaatattacaatgattcatcatccaagttatgtggccctttccaacatgccaaagctaggtcagtctgaaaaagaagatgtgaatggaagcaaatggactgttacaaccttttccactacgccccacatgccaacttacttagtcgcatttgttatatgtgactatgaccacgtcaacagaacagaaaggggcaaggagatacgcatctgggcccggaaagatgcaattgcaaatggaagtgcagactttgctttgaacatcacaggtcccatcttctcttttctggaggatttgtttaatatcagttactctcttccaaaaacagatataattgccttgcctagttttgacaaccatgcaatggaaaactggggactaatgatatttgatgaatcaggattgttgttggaaccaaaagatcaactgacagaaaaaaagactctgatctcctatgttgtctcccacgagattggacaccagtggtttggaaacttggttaccatgaattggtggaacaatatctggctcaacgagggttttgcatcttattttgagtttgaagtaattaactactttaatcctaaactcccaagaaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaaggcgattcctgttattcacagactgcagttgattgatgatgccttttccttgtctaaaaacaattatattgagattgaaacagcacttgagttaaccaagtaccttgctgaagaagatgaaattatagtatggcatacagtcttggtaaacttggtaaccagggatcttgtttctgaggtgaacatctatgatatatactcattattaaagaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaaatcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcct

SEQ ID NO: 147357 - DNA, 3322 bp, Homo sapiens
  Payload ID: 9147
  Gene Symbol: LVRN
  Gene Name: laeverin
  Uniprot ID: Q6Q4G3
  ENST ID: ENST00000504467
  CDS Start-End: 165-2270
aaccgctgtctgctgagctccagtccgtccaggctcttccaggaggaagaggcacgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccccggggccctgggaccagctacgcctgccgccctggctcgtgccgctgcactacgatctggagctgtggccgcagctgaggcccgacgagcttccggccgggtctttgcccttcactggccgcgtgaacatcacggtgcgctgcacggtggccacctctcgactgctgctgcatagcctcttccaggactgcgagcgcgccgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcagggccctgttagcgtcccagctggaaccaacatttgccaggtatgttttcccttgttttgatgagccagctctgaaggcaacttttaatattacaatgattcatcatccaagttatgtggccctttccaacatgccaaagctaggtcagtctgaaaaagaagatgtgaatggaagcaaatggactgttacaaccttttccactacgccccacatgccaacttacttagtcgcatttgttatatgtgactatgaccacgtcaacagaacagaaaggggcaaggagatacgcatctgggcccggaaagatgcaattgcaaatggaagtgcagactttgctttgaacatcacaggtcccatcttctcttttctggaggatttgtttaatatcagttactctcttccaaaaacagatataattgccttgcctagttttgacaaccatgcaatggaaaactggggactaatgatatttgatgaatcaggattgttgttggaaccaaaagatcaactgacagaaaaaaagactctgatctcctatgttgtctcccacgagattggacaccagtggtttggaaacttggttaccatgaattggtggaacaatatctggctcaacgagggttttgcatcttattttgagtttgaagtaattaactactttaatcctaaactcccaagaaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaaggcgattcctgttattcacagactgcagttgattgatgatgccttttccttgtctaaaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttg

SEQ ID NO: 147358 - DNA, 3676 bp, Homo sapiens
  Payload ID: 9147
  Gene Symbol: LVRN
  Gene Name: laeverin
  Uniprot ID: Q6Q4G3
  ENST ID: ENST00000503329
  CDS Start-End: 262-858
gagttccatgccacctccccgccctttacagacatgctataaggtccccagcccagtcactccgcagtgcctctctcttcctccccatggactatacacaggccctgcttgtcctggaggaaagtttggacgtcattatatagatcaggagactgaagtactgaaaggttaaatgacttgccaaagaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaagatgagataagtcacgtgaaggtgctttataggcagcagtaatctttaaattgttgttattttgaaaactttgcggaaaaatgttctcatcttcttctgggcatatttgggtctaattctgcaggcgattcctgttattcacagactgcagttgattgatgatgccttttccttgtctaaccttcaagactttggacacttgaaagtaccaaattgaaatggaaggactgtcaactttgcttgggtttcatcctttctataagatgggacatttaccttctcgtttcttgacttattcacatgccttattgaagtcatgcattgaaacatggaacaaatatcgaacgtatgcaaattacttagcaagtgaaggttttttgagtgtgtgtgtttttaaatcaaacagaaacaattatattgagattgaaacagcacttgagttaaccaagtaccttgctgaagaagatgaaattatagtatggcatacagtcttggtaaacttggtaaccagggatcttgtttctgaggtgaacatctatgatatatactcattattaaagaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgcttattttgttgcgaaggccagtggaatataaaaatcaatggcattaatgaggagcacattctttgctgagggaaataacagtttttccaggccctagggtttatttagttcaacattgaagattgaaaagactaatgagaagataacatgacaatataaaaagacagaaactcaaaaagtatattcactagaagacagtggagccaaagaaaagcaagttgaaaaagaaagaggagacaatttaacgagccctaaaggcaagaagtgtgtcttctcctgcccatttctctctcccacagtacatcctgcattgaaccacgtgttgctggttactaaactttatggtgtcacaaaaagacaaatgattgtaggatccatggaagtgcacttaggcttgctgtggtggaggccatagtggagatgaaggctctgctctgaagctcttaattgtgtattcaccagtgggatggacaccctttcagcctaagcgtacgagtgaaaacaatgatgtcaaaagacaatagcaagtataggctactatttagggcaaaaggaatcttgaaatgaaagaaacagaactaaaaggctaactggagcataatccttacagttttgcactcaggggattaagtttgaaacatagtgtcttttggccaaattgaacctacttgtaatgtggaccaacttactttacacattttcatcagtcccaatgtatggaattagcttagttttctcatgcttgattaaaacaagacaactaaagctaatcattcctcttctagactttgtgtatatgatttaatcttttatttttatttttgtagaatgggggtaaaactacaaatctcctcctcagggtgatatttttaaagattaaggagtatgacatcaattaacagtctttaaagatgttacatacgctcaaagcaatgtgattaagactttttgcctatttcttgtataagttaaggcagccataaatgaaaatacaaaacaaacgtttgcttttgtatttgattcacaagaggattctccctgagtgtcaggggaggctgtgggacttcaccacgtggacaaacgaaagcacaggctactcagacttggccacaggtcataggtcagagaattttttcttcaaatgtagaaatgtaaattttcagcaataaaatatctgcatgcctacaaagtgttgtagctga

SEQ ID NO: 147359 - DNA, 2067 bp, Homo sapiens
  Payload ID: 9147
  Gene Symbol: LVRN
  Gene Name: laeverin
  Uniprot ID: Q6Q4G3
  ENST ID: ENST00000512314
  CDS Start-End: 242-838
gccctttacagacatgctataaggtccccagcccagtcactccgcagtgcctctctcttcctccccatggactatacacaggccctgcttgtcctggaggaaagtttggacgtcattatatagatcaggagactgaagtactgaaaggttaaatgacttgccaaagaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaagatgagataagtcacgtgaaggtgctttataggcagcagtaatctttaaattgttgttattttgaaaactttgcggaaaaatgttctcatcttcttctgggcatatttgggtctaattctgcaggcgattcctgttattcacagactgcagttgattgatgatgccttttccttgtctaaaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagata

SEQ ID NO: 147360 - DNA, 2354 bp, Homo sapiens
  Payload ID: 9147
  Gene Symbol: LVRN
  Gene Name: laeverin
  Uniprot ID: Q6Q4G3
  ENST ID: ENST00000514509
  CDS Start-End: 262-942
gagttccatgccacctccccgccctttacagacatgctataaggtccccagcccagtcactccgcagtgcctctctcttcctccccatggactatacacaggccctgcttgtcctggaggaaagtttggacgtcattatatagatcaggagactgaagtactgaaaggttaaatgacttgccaaagaatgagatctttttttctaacattttacataatatcctcagagaagatcacgccctggtgactagagctgtggccatgaaggtggaaaatttcaaaacaagtgaaatacaggaactctttgacatatttacttacagcaagggagcgtctatggcccggatgctttcttgtttcttgaatgagcatttatttgtcagtgcactcaagtcatatttgaagacattttcctactcaaacgctgagcaagatgatctatggaggcattttcaaatggccatagatgaccagagtacagttattttgccagcaacaataaaaaacataatggacagttggacacaccagagtggttttccagtgatcactttaaatgtgtctactggcgtcatgaaacaggagccattttatcttgaaaacattaaaaatcggactcttctaaccagcaatgacacatggattgtccctattctttggataaaaaatggaactacacaacctttagtctggctagatcaaagcagcaaagtattcccagaaatgcaagtttcagattctgaccatgactgggtgattttgaatttgaatatgactggatattatagagttaattatgataaattaggttggaagaaactaaatcaacaacttgaaaaggatcctaaggcgattcctgttattcacagactgcagttgattgatgatgccttttccttgtctaaccttcaagactttggacacttgaaagtaccaaattgaaatggaaggactgtcaactttgcttgggtttcatcctttctataagatgggacatttaccttctcgtttcttgacttattcacatgccttattgaagtcatgcattgaaacatggaacaaatatcgaacgtatgcaaattacttagcaagtgaaggttttttgagtgtgtgtgtttttaaatcaaacagaaacaattatattgagattgaaacagcacttgagttaaccaagtaccttgctgaagaagatgaaattatagtatggcatacagtcttggtaaacttggtaaccagggatcttgtttctgaggtgaacatctatgatatatactcattattaaagaggtacctattaaagagacttaatttaatatggaatatttattcaactataattcgtgaaaatgtgttggcattacaagatgactacttagctctaatatcactggaaaaactttttgtaactgcgtgttggttgggccttgaagactgccttcagctgtcaaaagaacttttcgcaaaatgggtggatcatccagaaaatgaaataccttatccaattaaagatgtggttttatgttatggcattgccttgggaagtgataaagagtgggacatcttgttaaatacttacactaatacaacaaacaaagaagaaaagattcaacttgcttatgcaatgagctgcagcaaagacccatggatacttaacagatatatggagtatgccatcagcacatctccattcacttctaatgaaacaaatataattgaggttgtggcttcatctgaagttggccggtatgtcgcaaaagacttcttagtcaacaactggcaagctgtgagtaaaagtcttttatttacttttttaactacagccacactttgagcaggtatggaacacaatcattgattaatctaatatatacaatagggagaaccgtaactacagatttacagattgtggagctgcagcagtttttcagtaacatgttggaggaacaccagaggatcagagttcatgccaacttacagacaataaagaatgaaaatctgaaaaacaagaagctaagtgccaggatagctgcgtggctaaggagaaacacatagcttgtggctatctttcagcactcctcttgcatattataatgtagtttgttcacagttttgtcttccaatactttgtgagtctggaaaaccacacattttatttgtatttcagtcacatttattactcagagtgccattcttctcatattgtcatgtttggccctgagggtgggtgattgctgacaattttgccaatgctgctgtatttctgggaaagatgtcacttcatgttgggttataatcccacagaatttactttaaatgtcacgtaaaaacaaattcacctaagatagtcttgctta

SEQ ID NO: 147361 - DNA, 3137 bp, Homo sapiens
  Payload ID: 9148
  Gene Symbol: LMNA
  Gene Name: lamin A/C
  Uniprot ID: P02545
  ENST ID: ENST00000347559
  CDS Start-End: 250-2154
aggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggc

SEQ ID NO: 147362 - DNA, 1713 bp, Homo sapiens
  Payload ID: 9148
  Gene Symbol: LMNA
  Gene Name: lamin A/C
  ENST ID: ENST00000361308
  CDS Start-End: 250-1713
aggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctga

SEQ ID NO: 147363 - DNA, 1679 bp, Homo sapiens
  Payload ID: 9148
  Gene Symbol: LMNA
  Gene Name: lamin A/C
  ENST ID: ENST00000368297
  CDS Start-End: 103-1578
gtgtgctgcctggcaatggggaactctgagggctgatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 147364 - DNA, 2253 bp, Homo sapiens
  Payload ID: 9148
  Gene Symbol: LMNA
  Gene Name: lamin A/C
  Uniprot ID: P02545
  ENST ID: ENST00000368299
  CDS Start-End: 198-2042
gagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaa

SEQ ID NO: 147365 - DNA, 3190 bp, Homo sapiens
  Payload ID: 9148
  Gene Symbol: LMNA
  Gene Name: lamin A/C
  Uniprot ID: P02545
  ENST ID: ENST00000368300
  CDS Start-End: 213-2207
actcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggc

SEQ ID NO: 147366 - DNA, 2461 bp, Homo sapiens
  Payload ID: 9148
  Gene Symbol: LMNA
  Gene Name: lamin A/C
  Uniprot ID: P02545
  ENST ID: ENST00000368301
  CDS Start-End: 642-2360
attccttgacccgaggaggatagggatgtggccttcggtctttcctcgcagctccggggcaagctaggagtgggatggaagtcgagagtcgatcccggagcccggccgcggggagaggttctcggcagagaagacaaagcccgcagcagcgatggggggagagctgggctctgcgtgttgtgggggccaggaaagggtgccaggctggggctggaaccccctggcaaaggatggggtcccctcatccctaaacagcaagccatctcccctcgcccgccccccgcccccccagtctcggagatctcagaggcaccgactgggagacttgatgtaattgtcttcacaattctgtgaagatggacttggtgtctctgcttcacatgaagggacctgaggttcagagaggctaagtaactttcctaggtcacagagctgtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctgaggccgagcctgcactggggccacccagccaggcctgggggcagcctctccccagcctccccgtgccaaaaatcttttcattaaagaatgttttggaacttt

SEQ ID NO: 147367 - DNA, 1943 bp, Homo sapiens
  Payload ID: 9148
  Gene Symbol: LMNA
  Gene Name: lamin A/C
  Uniprot ID: P02545
  ENST ID: ENST00000448611
  CDS Start-End: 45-1769
gagaccctctgctcttctgctcccttcctgtgtgctgcctggcaatggggaactctgagggctgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagag

SEQ ID NO: 147368 - DNA, 2015 bp, Homo sapiens
  Payload ID: 9148
  Gene Symbol: LMNA
  Gene Name: lamin A/C
  Uniprot ID: P02545
  ENST ID: ENST00000473598
  CDS Start-End: 121-1818
aaacagccccaagggcccgggcctgctgcagctggggagccggacttccttgtcccaccaggcacagctcttcagacccctgccttgggtcacatttggaggcttaaagctggggcccagatggacctggaggcctgggatccacatctggaaccagatgctgaggctatggtagatggcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagc

SEQ ID NO: 147369 - DNA, 757 bp, Homo sapiens
  Payload ID: 9148
  Gene Symbol: LMNA
  Gene Name: lamin A/C
  ENST ID: ENST00000515459
  CDS Start-End: 118-234
ttctgctcccttcctgtgtgctgcctggcaatggggaactctgagggctgatttgccagtgatgggaagagttagaaacaggatgcccagcccttctcgcctcaagaggccactgggatgcagccactcctgtgcttggggaacctggaggatgcaagggaaaggactggcactctgctggcacagcacccggcctggggcaggacacgggcgaagccagggtctcccctgtgagcactagaggatttcccgacccctgcccggcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaac

SEQ ID NO: 147370 - DNA, 848 bp, Homo sapiens
  Payload ID: 9148
  Gene Symbol: LMNA
  Gene Name: lamin A/C
  ENST ID: ENST00000508500
  CDS Start-End: 1-783
gcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccacc

SEQ ID NO: 147371 - DNA, 546 bp, Homo sapiens
  Payload ID: 9148
  Gene Symbol: LMNA
  Gene Name: lamin A/C
  ENST ID: ENST00000504687
  CDS Start-End: 1-546
tttcttccccaaacagccccaagggcccgggcctgctgcagctggggagccggacttccttgtcccaccaggcacagctcttcagacccctgccttgggtcacatttcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaag

SEQ ID NO: 147372 - DNA, 3745 bp, Homo sapiens
  Payload ID: 9149
  Gene Symbol: LBR
  Gene Name: lamin B receptor
  Uniprot ID: Q14739
  ENST ID: ENST00000272163
  CDS Start-End: 97-1944
gtcgcgcgcgtggatctgccgccgggttgctgtgcgactattctccgggagccgtccgtgtcaccgccggaacctggcgcaggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatca

SEQ ID NO: 147373 - DNA, 3812 bp, Homo sapiens
  Payload ID: 9149
  Gene Symbol: LBR
  Gene Name: lamin B receptor
  Uniprot ID: Q14739
  ENST ID: ENST00000338179
  CDS Start-End: 165-2012
gttcaattaaaaccaggcttgtaggttgcaggtcaagttgtgtttcggtgtgtaacgcataaaacttcttgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggttgtagaaggaacgcctcttattgatggaagaagactcaagtatagattaaatggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggaaatgctgtctatgatttcttcattggccgtgaattaaaccctcgaattggtacttttgatctcaaatacttttgtgaattgcgccccggattgattggatgggtggttattaacttggtgatgcttttggctgaaatgaaaatacaggaccgcgctgttccatccttggccatgattttagttaatagtttccagcttctctatgtggtggatgctctctggaatgaggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggccttggcgtggtccctcccatgtggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatc

SEQ ID NO: 147374 - DNA, 874 bp, Homo sapiens
  Payload ID: 9149
  Gene Symbol: LBR
  Gene Name: lamin B receptor
  ENST ID: ENST00000425080
  CDS Start-End: 235-874
agcagaaaaaaaaaagcttaggatccgtaacagattcggagtcaacaatgacatgactcagcattttggggttcaattaaaaccaggcttgtaggttgcaggtcaagttgtgtttcggtgtgtaacgcataaaacttcttgttccacgctccgcggtgttggggattttctactgcatctcgacagcatctcgggtaacaaccgagcccctcctcgcagcgttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaatgatattaagcctttaacttcctttaggcaaaggaaaggtggctcaacttccagttccccttccagacgccgagggagtcgatcaaggtcacgctcccgatcccctggtcgaccacctaaaagtgcccgccgatctgcttctgcttcccaccaggccgacattaaggaagcaaggagggaagtggaagttaaattgactccgctgattctgaagccatttggaaatagcatcagcagatataatggggagcctgagcatattgagagaaatgacgcacctcataaaaatacacaggaaaaattcagtttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctg

SEQ ID NO: 147375 - DNA, 736 bp, Homo sapiens
  Payload ID: 9149
  Gene Symbol: LBR
  Gene Name: lamin B receptor
  ENST ID: ENST00000421383
  CDS Start-End: 582-736
gccgctgggggaggaagcccgaggccggcgcagcggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagcgcccgtctgacagatgagcaggcggccccgcggtcctgcagtaggaggctgacagggcgcggcggcctggcgggacggggaagggtctgcggccgaggtgggcttagattcgcgctgcttgtcactggctttgagggtcgtggtcgtcgcggtttggtgattctccaggcacactgcatggctgctcgctcctatgcgttgaattccttcgcccggacagtctcaaaaatcgggttaattatagaaaatgccaagtaggaaatttgccgatggtgaagtggtaagaggtcgatggcctgggagttcactttattatgaagtagaaattctgagccacgacagcacctcccagctttacactgtgaagtataaagatggaacagagcttgaattgaaagagaa

SEQ ID NO: 147376 - DNA, 2878 bp, Homo sapiens
  Payload ID: 9150
  Gene Symbol: LMNB1
  Gene Name: lamin B1
  Uniprot ID: P20700
  ENST ID: ENST00000261366
  CDS Start-End: 362-2122
ctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaatattga

SEQ ID NO: 147377 - DNA, 1572 bp, Homo sapiens
  Payload ID: 9150
  Gene Symbol: LMNB1
  Gene Name: lamin B1
  ENST ID: ENST00000395354
  CDS Start-End: 321-1484
cgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggtaaggaacttaagggtcaccctaccttatggtccactttttgcctctcaccctttttattgaaataaaaataaatagcattttaaaaagaa

SEQ ID NO: 147378 - DNA, 3475 bp, Homo sapiens
  Payload ID: 9150
  Gene Symbol: LMNB1
  Gene Name: lamin B1
  ENST ID: ENST00000460265
  CDS Start-End: 887-1876
ggagcgggggataaggttaccacgcccgcggtggccggggacactctgagtttcgcgtgtggcttttagggacgtttatatttgaatttccctgaaccgccgagtgtgggcggtggcgcagatccgtcccggaaacctccgggctccttcccgcctttctcaggcccggcccctccaaggggtccccgcggggcggcgggagggccctgggcccagagccgcgcgggtgggcagtcccaggcgtccttccttacagccctgagcctggtccgggaaccgcccagccgggagggccgagctgacggttgcccaagggccagattttaaatttacaggcccggcccccgaaccgccgaagcgcgctgcctgctccccattggcccatggtagtcacgtggaggcgccggggcgtgccggccatgttggggagtgcggcgccgcggcccgcgccacctccgccccccgcggcttgcctccagcccgcccctcccggccctcctccccccgcccgccgctccgtgcagcctgagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttcccccccgcgcgcctttgccctttgtgctgtaatcgagctcccgccatcccaggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctgaaggatcagattgcccagttggaagcctccttagctgcagccaaaaaacagttagcagatgaaactttacttaaagtagatttggagaatcgttgtcagagccttactgaggacttggagtttcgcaaaagcatgtatgaagaggagattaacgagaccagaaggaagcatgaaacgcgcttggtagaggtggattctgggcgtcaaattgagtatgagtacaagctggcgcaagcccttcatgagatgagagagcaacatgatgcccaagtgaggctgtataaggaggagctggagcagacttaccatgccaaacttgagaatgccagactgtcatcagagatgaatacttctactgtcaacagtgccagggaagaactgatggaaagccgcatgagaattgagagcctttcatcccagctttctaatctacagaaagagtgtttgttgctgagtcatatcagtttcatcatgctgcctattaggccataagaatttccttttggttaaataactcagtctagagcatgtttggaaaggattcaagaattagaggacttgcttgctaaagaaaaagacaactctcgtcgcatgctgacagacaaagagagagagatggcggaaataagggatcaaatgcagcaacagctgaatgactatgaacagcttcttgatgtaaagttagccctggacatggaaatcagtgcttacaggaaactcttagaaggcgaagaagagaggttgaagctgtctccaagcccttcttcccgtgtgacagtatcccgagcatcctcaagtcgtagtgtacgtacaactagaggaaagcggaagagggttgatgtggaagaatcagaggcgagtagtagtgttagcatctctcattccgcctcagccactggaaatgtttgcatcgaagaaattgatgttgatgggaaatttatccgcttgaagaacacttctgaacaggatcaaccaatgggaggctgggagatgatcagaaaaattggagacacatcagtcagttataaatatacctcaagatatgtgctgaaggcaggccagactgttacaatttgggctgcaaacgctggtgtcacagccagccccccaactgacctcatctggaagaaccagaactcgtggggcactggcgaagatgtgaaggttatattgaaaaattctcagggagaggaggttgctcaaagaagtacagtctttaaaacaaccatacctgaagaagaggaggaggaggaagaagcagctggagtggttgttgaggaagaacttttccaccagcagggaaccccaagagcatccaatagaagctgtgcaattatgtaaaattttcaactgtcttcctcaaaataaagaagtatggtaatctttacctgtatacagtgcagagccttctcagaagcacagaatatttttatatttcctttatgtgaatttttaagctgcaaatctgatggccttaatttcctttttgacactgaaagttttgtaaaagaaatcatgtccatacactttgttgcaagatgtgaattattgacactgaacttaataactgtgtactgttcggaaggggttcctcaaattttttgactttttttgtatgtgtgttttttctttttttttaagttcttatgaggaggggagggtaaataaaccactgtgcgtcttggtgtaatttgaagattgccccatctagactagcaatctcttcattattctctgctatatataaaacggtgctgtgagggaggggaaaagcatttttcaatatattgaacttttgtactgaatttttttgtaataagcaatcaaggttataattttttttaaaatagaaattttgtaagaaggcaatattaacctaatcaccatgtaagcactctggatgatggattccacaaaacttggttttatggttacttcttctcttagattcttaattcatgaggagggtgggggagggaggtggagggagggaagggtttctctattaaaatgcattcgttgtgttttttaagatagtgtaacttgcttaaatttcttatgtgacattaacaaataaaaaagctcttttaa

SEQ ID NO: 147379 - DNA, 738 bp, Homo sapiens
  Payload ID: 9150
  Gene Symbol: LMNB1
  Gene Name: lamin B1
  ENST ID: ENST00000492190
  CDS Start-End: 241-738
aagtgctgcgagcaggagacggcggcggcgcgaaccctgctgggcctccagtcaccctcgtcttgcattttcccgcgtgcgtgtgtgagtgggtgcttctccgttcctctaaacgccagcgtctggacgtgagcgcaggtcgccggtttgtgccttcggtccccgcttcgccccctgccgtcccctccttatcacggtcccgctcgcggcctcgccgccccgctgtctccgccgcccgccatggcgactgcgacccccgtgccgccgcggatgggcagccgcgctggcggccccaccacgccgctgagccccacgcgcctgtcgcggctccaggagaaggaggagctgcgcgagctcaatgaccggctggcggtgtacatcgacaaggtgcgcagcctggagacggagaacagcgcgctgcagctgcaggtgacggagcgcgaggaggtgcgcggccgtgagctcaccggcctcaaggcgctctacgagaccgagctggccgacgcgcgacgcgcgctcgacgacacggcccgcgagcgcgccaagctgcagatcgagctgggcaagtgcaaggcggaacacgaccagctgctcctcaactatgctaagaaggaatctgatcttaatggcgcccagatcaagcttcgagaatatgaagcagcactgaattcgaaagatgcagctcttgctactgcacttggtgacaaaaaaagtttagagggagatttggaggatctg

SEQ ID NO: 147380 - DNA, 4671 bp, Homo sapiens
  Payload ID: 9151
  Gene Symbol: LMNB2
  Gene Name: lamin B2
  ENST ID: ENST00000325327
  CDS Start-End: 64-1926
gccgcggcgggcggcgggcgcggcgcggcgcggcgccatcttgcagccggcggcgcggattgaatgagcccgccgagcccgggccgccgtcgggagcagcgcaggccgcgagccgccgccaccatggccacgccgctgcccggccgcgcgggcgggcccgccacgccgctgtcgcccacgcgcctgtcgcggctgcaggagaaggaggagctgcgcgagctcaacgaccgcctggcgcactacatcgaccgcgtccgcgcgctggagctggagaacgaccggctcctgctcaagatctcagagaaggaggaggtgaccacgcgcgaggtgagtggcatcaaggcgctgtacgagtcggagctggccgatgcccggagagtcctggatgagacggctcgagagcgtgcccggctgcagatagagattgggaagctgagggcagagttggacgaggtcaacaagagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggccgaggacggtcatgcagtggccaaaaagcagctggagaaggagacgctgatgcgtgtggacctggagaaccgctgccagagcctgcaggaggagctggacttccggaagagtgtgttcgaggaggaggtgcgggagacgcggcggcggcacgagcggcgcctggtggaggtggacagcagccggcagcaggagtacgacttcaagatggcacaggcgctggaggagctgcggagccagcacgacgagcaagtgcggctctacaagctggagctggagcagacctaccaggccaagctggacagcgccaagctgagctctgaccagaacgacaaggcggccagtgcggctcgcgaggagctgaaggaggcccgcatgcgcctggagtccctcagctaccagctctccggcctccagaagcaggccagtgccgctgaagatcgcattcgggagctggaggaggccatggccggggagcgggacaagttccggaagatgctggacgccaaggagcaggagatgacggagatgcgggacgtgatgcagcagcagctggccgagtaccaggagctgctggacgtgaagctggccctggacatggagatcaacgcctaccggaagctcctggagggcgaggaggagaggctgaagctgtcccccagcccatcctcgcgcgtcaccgtctcacgagccacctcgagcagcagcggcagcttgtccgccaccgggcgcctgggccgcagtaagcggaagcggctggaggtggaggagcccttgggcagcggcccaagcgtcctgggcacgggcacgggtggcagcggtggcttccacctggcccagcaggcctcggcctcgggtagcgtcagcatcgaggagatcgacctggagggcaagtttgtgcagctcaagaacaactcggacaaggatcagtctctggggaactggagaatcaagaggcaggtcttggagggggaggagatcgcctacaagttcacgcccaagtacatcctgcgcgccggccagatggtcacggtgtgggcagctggtgcgggggtggcccacagccccccctcgacgctggtgtggaagggccagagcagctggggcacgggcgagagcttccgcaccgtcctggttaacgcggatggcgaggaagtggccatgaggactgtgaagaagtcctcggtgatgcgtgagaatgagaatggggaggaagaggaggaggaagccgagtttggcgaggaggatcttttccaccaacagggggacccgaggaccacctcaagaggctgctacgtgatgtgaacccacactcctcatccacacacctttctttacccagagccactgaaaactatttttatatcattggctttctttagttcttgatacatttctagagaatttctaagcgaactgccagaacgtgtgggtgggtctcccccagccctccctcctggcgggtctcctccagcctcacttcgctgccacttcgccgctgccccggagacttttcaatcccaccccactcctcatctcaccatttggtcaaattggaagcccagggccaggacccggaggtttagaagatgcttgggcttggagggaggagggccggcgaggctagcgaggggacaggagacggccctgctgcggacggagcgcggaaactgcgtaggaattcagtggtggtgggtttttttaaggctttctacaaaaccaaattcagaatccaggcgtcgacctggtggggcccggggccaagcctgcattctggctgcccagcttcggacagcgggaactcctcaggcagccacgcagcgggtgtgggccagcatggggatggcgtggcccccagggcgggttttcactccgctgcctgggcttccagattcccgttctggcagcgcaccggccgggtttctcggaccgttgactttatttgggggagttttcccgcagttcagttcctgactgtgcaaggccaacagggcaggggaggggaagacctggggaaggaagaatgaggacagtcccgtcgtaagacctgtcacaacaataagcagggaggggagatgtggaggggacacatctggttgccttggaggcagaagctgtgagtttcagaacagctgtctgcagggaacgccaccatgttgaccctctggaggagagcgctgtggagcccctcccgtgttccagctccgtctgccctgtgcctatatatacacatgcgtctatccatactgtgcttttatctgtgattttctcgctgaaaccatgtttctcagacaggccaaggccacctgactcctatcacgacgcacccaagcccctcagtccagcttcccaatgcctggcaccccccttcggcaatagctcaccgtttacaccctccctcatagatacacagaagttatttttttaatggatatttatttttttacattggtcagtacacaggtcaggagctcacgccagggccttgaggacaggctgaccctcctccccggggtggcgtggggctggggcaccctccgacggcagagcctccttcagaaagtgcagctcaagtcttaaagacaccaaaactgagccatgggcacgcgccgtctccgggccatggcgttcactgcagggcgggggcggcaccgctcccctgtgactgcatcccgcctccctggggacctgcctgtggcaggaaggaatggggggccccagccccaggccgggaaggagccagcggccgacaaagcagaaacacccgctgctccacgtagcccctgctcgctgtccttgctctcagaagtcccggtcccatgtagatagaggggggcgcatcttaccaaagcatttcctcctggaggctacgccgctgtgctcccagtcaggcggctggtagggagctttgcctgccccggggataccctctgccagccgctggaagtgggaatgctggcgacagactgtgtcctctttcccaccttcatagcaggaatcacccggacccgactggctgggcttcgtgctagcgagggttctgggggtgggtcttggtgatcttgtcctatggggagtctgcagtggtctcagccacatcctatgtattttggctctggaggagcaaagctgtatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgaagggggtggggagaagcgtggactgggcagcctgtgggtaattggaggttcattgagaattgagtctttggaaacactaagaaaatcaaatttttaaaagttatttatggcctgggaaacaatttgcatttgtccccaaatacgcttagctgtgtgccgcttagaacgatgcgaaaccatccctctgtgtaagcccgtgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgatttta

SEQ ID NO: 147381 - DNA, 1718 bp, Homo sapiens
  Payload ID: 9152
  Gene Symbol: LMNTD1
  Gene Name: lamin tail domain containing 1
  Uniprot ID: Q8N9Z9
  ENST ID: ENST00000282881
  CDS Start-End: 151-1317
aagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacagaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccattttacattgactgataaatctcttttttccat

SEQ ID NO: 147382 - DNA, 1520 bp, Homo sapiens
  Payload ID: 9152
  Gene Symbol: LMNTD1
  Gene Name: lamin tail domain containing 1
  Uniprot ID: Q8N9Z9
  ENST ID: ENST00000413632
  CDS Start-End: 244-1353
agtcataaaggtctctttgccaagttactgccctctcaagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacaggaaagaaaagagacttcttttctagccaagatgaaagatacacaagacattcaggaagcttcgaaggcaatgcagaataaagtccatgagcaggaagataagaatgagaaacaaaaacaaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagctttacctttatggtgtcatggtccagttgtatggaagagtaaaaagacctgcaatctaggctccctgccatgctggccaaagacattccacaacttaaagaaaatcaaatgcctgagcaaacgtagcgggttccgctttcatag

SEQ ID NO: 147383 - DNA, 1285 bp, Homo sapiens
  Payload ID: 9152
  Gene Symbol: LMNTD1
  Gene Name: lamin tail domain containing 1
  Uniprot ID: Q8N9Z9
  ENST ID: ENST00000445693
  CDS Start-End: 4-981
tacatgcaacagccagtgagagcaggagacatcggtgtttccagagtccagacccaccacaatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagatggagtctcactctgttgcccaggctggagtgcagtggtgtgatctccactaactgcagcctccgcctcccaggttcaagtgagtctcctgcgtcagcctcccgagtagctgggattacaggcatccgccaccctgcatggctaatttttgtatttttagtagcaacgaggtttcaccatgttggccaggctggtctcgaattcctgacctcaggtgatctgcctgccttggcctcccaaagtgctgggattacacgcatgagccaccatgcccggcgcaa

SEQ ID NO: 147384 - DNA, 1677 bp, Homo sapiens
  Payload ID: 9152
  Gene Symbol: LMNTD1
  Gene Name: lamin tail domain containing 1
  Uniprot ID: Q8N9Z9
  ENST ID: ENST00000458174
  CDS Start-End: 246-1475
gtagtcataaaggtctctttgccaagttactgccctctcaagctgcttccagtgaatgctacacacctgcaccatggtttgtccgacatccttagccaagatcaggattggctatgttggtacttacatatcctcatgagaattgtggttctggtactagtttggtaaagaaattattaaacctagctgatgcttgaaggtagttggattaacaggaaagaaaagagacttcttttctagccaagatgaaagatacacaagacattcaggaagcttcgaaggcaatgcagaataaagtccatgagcaggaagataagaatgagaaacaaaaacaaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaat

SEQ ID NO: 147385 - DNA, 454 bp, Homo sapiens
  Payload ID: 9152
  Gene Symbol: LMNTD1
  Gene Name: lamin tail domain containing 1
  ENST ID: ENST00000539523
  CDS Start-End: 1-318
cagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaaggcttcctattctttacttgacttaagatgaaaactacagccacgtgaaccctaacttgttggtattctggactctcctggtagaaatgacttaattttactactccatacagcc

SEQ ID NO: 147386 - DNA, 636 bp, Homo sapiens
  Payload ID: 9152
  Gene Symbol: LMNTD1
  Gene Name: lamin tail domain containing 1
  ENST ID: ENST00000543629
  CDS Start-End: 1-490
agacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagactttcaggattaagcatttcctggccaagaaacaaaagcaaaatcgtcccattccccagtggattcggatgaaaactggtaatacaatcaggtacaactccaaaaggagacaatggagaagaa

SEQ ID NO: 147387 - DNA, 716 bp, Homo sapiens
  Payload ID: 9152
  Gene Symbol: LMNTD1
  Gene Name: lamin tail domain containing 1
  ENST ID: ENST00000538178
  CDS Start-End: 206-716
gcctcctcctcctgctcctccggtcgccctcccaatggatccctgtggtgccaggcaggaatgggctgcttgaggacccagcaagctcaaggggcctttctgctgcttcctctacccctgtatttcactcagctctctaaattgactcagctccagaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaaca

SEQ ID NO: 147388 - DNA, 1729 bp, Homo sapiens
  Payload ID: 9152
  Gene Symbol: LMNTD1
  Gene Name: lamin tail domain containing 1
  Uniprot ID: Q8N9Z9
  ENST ID: ENST00000539744
  CDS Start-End: 481-1356
gccctctcaagctgcttccagtgaatgctacacacctgcaccatggtttgtccgacatccttagccaagatcaggattggctatgttgaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttgggaaaacggaaacttggaaaacttacatcacgtggcttagtaaatggcagaactgaaatataattacaagtctgtctaaatgcaagacacgttgttctttccacttcatcacgacgcgtctttgtaatatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagttcttcttaagagagagaaggaaatcccaccaaccgttttccctaatcgcagcccttggtgccagaatccctatgtctctgcacatccttactgtcctctgattgaaccacacaatacatccaccgctggaggcagattggatagacagcccaggactcggtcaaccagacctaatcgagcctcagggtctaagaaaaagaagacatctgagtcacaaaagcaataagcagtcaactcaacctttaaagtaatctagtccaccctcaaccagctactagaaaagcaaaagagaactcaaatccctgaggcctgctctgcaacctccctgctattccatgagagggtgaagacatcacatttctatatggaaaaaggatccaaaatttgtattgctgtagaattggtgaattatagatgcttgatgaaatcacaagtcctaccactcctgccttccaaatccctgcagaaaacaagcagatggttagtattattcaatggataaaattgctatttgccttagatttctctttttgtaaacaaagttattttgggtacagaactcacaaaagaagagcacgtgcaattgtttaaccatttta

SEQ ID NO: 147389 - DNA, 525 bp, Homo sapiens
  Payload ID: 9152
  Gene Symbol: LMNTD1
  Gene Name: lamin tail domain containing 1
  ENST ID: ENST00000542224
  CDS Start-End: 309-525
cataacagaagaagcttaaggacactacatgcaacagccagtgagagcaggagacatcggtgtttccagagtccagacccaccacagcttctgagcaagatcaccatttggagacagacttatctaaagattttgtgattgggaagctccatgaagattactttgaacaaactgtctgaaacttgaaacttccaatacatgtcctctagcctctcttgaaatacccctcgtaggagcttaatgtgactctaacttgaagaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcaccca

SEQ ID NO: 147390 - DNA, 582 bp, Homo sapiens
  Payload ID: 9152
  Gene Symbol: LMNTD1
  Gene Name: lamin tail domain containing 1
  ENST ID: ENST00000545543
  CDS Start-End: 152-582
aaggacactacatgcaacagccagtgagagcaggagacatcggtgtttccagagtccagacccaccacattctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccgattccttccaaacatcgtaatgcaggcaaattccacagtaacagtgtgggcagcagcatctgaagcaaagcatcaacctccatcagattttctttggaaggaacaagacaagtttagagcaagtcctgattgtataacaatcctgtgcaaaccgaacggtcaagccattgcgtggtacacccctatccactggaagcaagcgtgggaaaaattagatgctgacgttgaatttaacagatgttcagtagtatctccaacattccgaaagcgtgtgtttcagtggacagcatctacagctacaataactaaagaaaaacaagatcaacctaagaaagatatctcaaattatcaggtggaacaagctcaagt

SEQ ID NO: 147391 - DNA, 597 bp, Homo sapiens
  Payload ID: 9152
  Gene Symbol: LMNTD1
  Gene Name: lamin tail domain containing 1
  ENST ID: ENST00000540106
  CDS Start-End: 101-597
agccagtgagagcaggagacatcggtgtttccagagtccagacccaccacaaagagaagacaaacttggagtatattctttagtacatttttccccaaagatgttgggttcagttgccacaacactgccattgtcatcttcaaattccagtggaatgcctcttggttactatctgtctagtcctcagattagtagagtaactatatcaacaactggacaattgacttctaaagctactgtaggtagctgttccagagtggaaaacagcttggatgccagccccttctcagttccgaagaaacaggatgaatcacccatgattggggatggagaagattatttcctttctttgtttggtgattcaaagaaacttacagcacactcaaactacactcagaaaactttaaaatacttttctatgattcttgaagaagttggccaatttacctccagttctcttggagatgttgaaatagctgaagtgaatgtcaagggtttgttcgtgaagctcattaactcttcccttgacaaagaaatggcaattggagatcatattctccagcaaaatgtgaatggacaaaccatttctttgtaccg

SEQ ID NO: 147392 - DNA, 2084 bp, Homo sapiens
  Payload ID: 9153
  Gene Symbol: LMNTD2
  Gene Name: lamin tail domain containing 2
  Uniprot ID: Q8IXW0
  ENST ID: ENST00000329451
  CDS Start-End: 64-1968
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccggcagctacagcagggactcagaagatctccagaaaacccactcacccaggcacggcgagccggtcctgtcgccccagccctgcacagacccggaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcat

SEQ ID NO: 147393 - DNA, 1051 bp, Homo sapiens
  Payload ID: 9153
  Gene Symbol: LMNTD2
  Gene Name: lamin tail domain containing 2
  ENST ID: ENST00000441853
  CDS Start-End: 146-1051
cgaaaaacgcggaaatgcggtggctgcggcccgcgggcaggcgtcggggctgggctggcccagaactcacctaggggcctggtctggggtctccctggaggctcctggtaacaaacagccccaccccttctgggtgctggtatccatggcaacggtatacagcccttccctcccaggcctgcttggaggtcgggcctcagagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttc

SEQ ID NO: 147394 - DNA, 798 bp, Homo sapiens
  Payload ID: 9153
  Gene Symbol: LMNTD2
  Gene Name: lamin tail domain containing 2
  ENST ID: ENST00000486629
  CDS Start-End: 56-798
cttccctcccaggcctgcttggaggtcgggcctcagctcccgaagaacattgagaatggcccccaagtctggccaggaggttgaagaaaccgaggaagaggctctcctgtcccccacagagcaagagtcggtcagtggtcacctgggacctccagcaggcgcacctgcagcccccgagactcccacgtgcctgccagacaccacgccccaccccgcaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaggagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaa

SEQ ID NO: 147395 - DNA, 2091 bp, Homo sapiens
  Payload ID: 9153
  Gene Symbol: LMNTD2
  Gene Name: lamin tail domain containing 2
  Uniprot ID: Q8IXW0
  ENST ID: ENST00000621319
  CDS Start-End: 64-1968
cggaggggggcgccgagccgcagtccccgcccccacctcccgcctaccgcgaaaaacgcggaaatgcggtggctgcggcccgcgggcaggcgtcgggagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttcgtgcaggtgatagggcacccgccccgggaccaccgcgcttcctccgagcaagcgctggtgcaggccgggagctacagcagggactcagaagatctccagaaaacccactcacccaggcacggcgagccggtcctgtcgccccagccctgcacagaccccgaccactggagcccggaactcctgcagagcccgacaggcctgaagatcgtggctgtgagctgccgggagaagttcgtccgcatcttcaacccgtcgcaggagagcacggccgacctgagcggcatggtgctgaagcagctggtgcgcggcttcccggagcgcctgtaccgcttcccgccgggcacgctgctggccccgcggcaccacgtcacggtctggggcgaggcgacccgcagcgccaagaagccgctgcgcgcgtcctcgagccgggagcccgttcccctcctctccatccgcggctgcgcgacgctgctcctgagccccaagggcgaggtcctcagtgagcaccggatcccacgccgcgagactccggccccgagggtcttcgccgacggcaccgacttgtccatcgaccgcttcccgctccctgaggccgggcccggcgccgacacccgcaagccgccgcgcccacctcgacccctgcgcaaaggccgggtgcgggagccccgggtcagtcgccggagaccagggacgcggggcctgctgcccccagtgagctcggggaagctcttccacgcgcgggaggggcctgcgcggcccgagaaccccgagatccccgcgccgcagcacctgcccgccatcccgggtgaccccaccctgccgtcgcctcccgcagaggccgggctgggcctggaggactgtcggctccagaaagaacaccgagttcgggtgtgccggaagagcgtggaccgtagctgccccctggtggccctgtcggtgcagaacacggcggagagcagattcggcttccgcttcctcagctgcctgccggtcaccgcggacacctgccgcggcgcctaggggcggaggagtggggccgggaccgcgagggagggcgcgggcgggcgccggggctgggcgggctgtgtccgctgcatcatttattgaaccaacgtggcctacaaagtaaaccgcatttctgta

SEQ ID NO: 147396 - DNA, 1051 bp, Homo sapiens
  Payload ID: 9153
  Gene Symbol: LMNTD2
  Gene Name: lamin tail domain containing 2
  ENST ID: ENST00000631419
  CDS Start-End: 146-1051
cgaaaaacgcggaaatgcggtggctgcggcccgcgggcaggcgtcggggctgggctggcccagaactcacctaggggcctggtctggggtctccctggaggctcctggtaacaaacagccccaccccttctgggtgctggtatccatggcaacggtatacagcccttccctcccaggcctgcttggaggtcgggcctcagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaagcagccccggccctggccacagctggacacagggagcccagagtcctctggaaagcattccgagcggcatcacaagaccgtggagtggggctccctgccctgtctgaacaccagcagctcagggggcgctgactccgactccagcagctgccggccgggcctgccttccttc

SEQ ID NO: 147397 - DNA, 798 bp, Homo sapiens
  Payload ID: 9153
  Gene Symbol: LMNTD2
  Gene Name: lamin tail domain containing 2
  ENST ID: ENST00000633856
  CDS Start-End: 56-798
cttccctcccaggcctgcttggaggtcgggcctcagctcccgaagaacattgagaatggcccccaagtctggccaggaggttaaagaaaccgaggaagaggctctcctgtcccccacagagcaagagtcggtcagtggtcacctgggacctccagcaggcgcacctgcagcccccgagactcccacgtgcctgccagacaccacgccccaccccacaccggtggtctgctctgccgacccgcagttggctcttgagtccctggaccctcgcacactgcggctgctgtggagacagcgagaactggagatccaggccttgcggtgggccatccagaatggcgaggacgcccggctctgccacatcctggaagaggtggcggggcttccgcccaagaggagctcccacagtcaggagaaactcctgcagaaccaggtccagaagctgatccaggagttgaaggaacagaaggagcgagcccagtgggagaaggagcacctggaggagcggctgctgcagaccacccgcacgctccaagagatggaggccgagctgcagaacttgcagaagtcctgcctcctgcagctggcccgctcctcgtgggtgggccgcatgctacgatcccagactggcagtgtggaggtagtgacggcagagactctgatggacccaagcgacctctctgaaaacattcaggcccccaccggggagggctttcggctggaggacgtggattggaacagcgttgcccgccggtatcccaacctcttcaccaacatggagcccagctcaaagcaaaa

SEQ ID NO: 147398 - DNA, 9657 bp, Homo sapiens
  Payload ID: 9154
  Gene Symbol: LAMA1
  Gene Name: laminin, alpha 1
  Uniprot ID: P25391
  ENST ID: ENST00000389658
  CDS Start-End: 95-9322
cggggccagggcagcgcggactcgcgtcccgtggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggttggagtccgtctctctggacatagccagctctaatgccatcgacctggtggtggccgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctaaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 147399 - DNA, 9640 bp, Homo sapiens
  Payload ID: 9155
  Gene Symbol: LAMA2
  Gene Name: laminin, alpha 2
  Uniprot ID: P24043
  ENST ID: ENST00000421865
  CDS Start-End: 50-9418
cagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaaaatcattgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattctaaataa
